US006656906B1

(12) United States Patent
Barney et al.

(10) Patent No.: US 6,656,906 B1
(45) Date of Patent: *Dec. 2, 2003

(54) HYBRID POLYPEPTIDES WITH ENHANCED PHARMACOKINETIC PROPERTIES

(75) Inventors: Shawn Barney, Apex, NC (US); Kelly I. Guthrie, Virginia Beach, VA (US); Gene Merutka, Saratoga, CA (US); Mohmed K. Anwer, Foster City, CA (US); Dennis M. Lambert, Cary, NC (US)

(73) Assignee: Trimeris, Inc., Durham, NC (US)

( * ) Notice: Subject to any disclaimer, the term of this patent is extended or adjusted under 35 U.S.C. 154(b) by 0 days.

This patent is subject to a terminal disclaimer.

(21) Appl. No.: 09/350,641

(22) Filed: Jul. 9, 1999

Related U.S. Application Data

(63) Continuation-in-part of application No. 09/315,304, filed on May 20, 1999, now Pat. No. 6,348,568, which is a continuation-in-part of application No. 09/082,279, filed on May 20, 1998, now Pat. No. 6,258,782.

(51) Int. Cl.[7] .................... A61K 38/16; C07K 2/00; C07K 14/00
(52) U.S. Cl. ................ 514/12; 514/2; 514/13; 514/15; 530/300; 530/324; 530/326; 530/328; 530/350
(58) Field of Search ................ 530/300, 313, 530/324, 326, 328, 350, 397, 398, 399, 351; 514/2, 12, 13, 15, 21; 424/85.1, 85.2, 85.4, 85.5, 85.6, 85.7

(56) References Cited

U.S. PATENT DOCUMENTS

| | | | | |
|---|---|---|---|---|
| 5,122,614 A | * | 6/1992 | Zalipsky | 548/520 |
| 5,357,041 A | * | 10/1994 | Roberts et al. | 530/326 |
| 5,358,934 A | | 10/1994 | Borovsky et al. | 514/17 |
| 5,464,933 A | | 11/1995 | Bolognesi et al. | 530/324 |
| 5,656,480 A | | 8/1997 | Wild et al. | 435/325 |
| 5,723,129 A | | 3/1998 | Potter et al. | 424/200.1 |
| 5,763,160 A | | 6/1998 | Wang | 435/5 |
| 5,843,913 A | | 12/1998 | Li et al. | 514/44 |
| 5,932,462 A | * | 8/1999 | Harris et al. | 435/188 |
| 5,968,776 A | | 10/1999 | Klein et al. | 435/69.3 |
| 6,080,724 A | | 6/2000 | Chassaing et al. | 514/13 |
| 6,258,782 B1 | * | 7/2001 | Barney et al. | 514/13 |
| 6,348,568 B1 | * | 2/2002 | Barney et al. | 530/300 |

FOREIGN PATENT DOCUMENTS

| | | |
|---|---|---|
| EP | 272858 | 6/1988 |
| EP | 306912 | 3/1989 |

(List continued on next page.)

OTHER PUBLICATIONS

Adams et al., 1985, "The c–myc oncogene driven by immunoglobulin enhancers induces lymphoid malignancy in transgenic mice", Nature 318:533–538.

(List continued on next page.)

*Primary Examiner*—Jeffrey E. Russel
(74) *Attorney, Agent, or Firm*—Pennie & Edmonds LLP

(57) ABSTRACT

The present invention relates to enhancer peptide sequences originally derived from various retroviral envelope (gp41) protein sequences that enhance the pharmacokinetic properties of any core polypeptide to which they are linked. The invention is based on the discovery that hybrid polypeptides comprising the enhancer peptide sequences linked to a core polypeptide possess enhanced pharmacokinetic properties such as increased half life. The invention further relates to methods for enhancing the pharmacokinetic properties of any core polypeptide through linkage of the enhancer peptide sequences to the core polypeptide. The core polypeptides to be used in the practice of the invention can include any pharmacologically useful peptide that can be used, for example, as a therapeutic or prophylactic reagent.

82 Claims, 30 Drawing Sheets

FOREIGN PATENT DOCUMENTS

Figure 3:
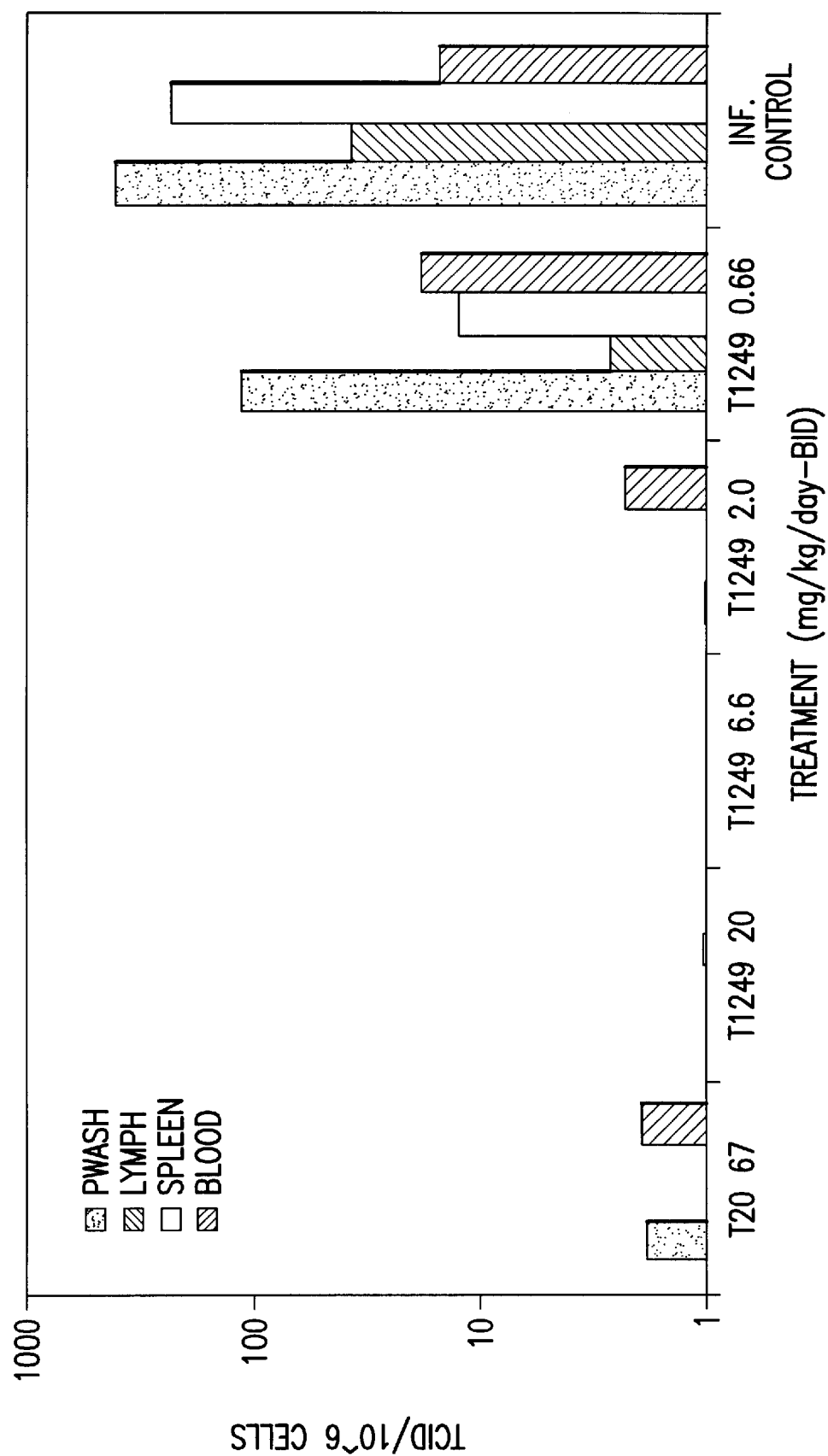

| EP | 578293 | 1/1994 |
|---|---|---|
| WO | WO 91/07664 | 5/1991 |
| WO | WO 91/09872 | 7/1991 |
| WO | WO 93/14207 | 7/1993 |
| WO | 94/28920 | * 12/1994 |
| WO | WO 96/19495 | 6/1996 |
| WO | 96/40101 | * 12/1996 |
| WO | WO 99/59615 | 11/1999 |

OTHER PUBLICATIONS

Alexander et al., 1987, "Expression of the c–myc oncogene under control of an immunoglobulin enhancer in Eμ–myc transgenic mice", Mol. Cell. Biol. 5:1436–1444.

Fingl & Woodbury, 1975, in "The Pharmacological Basis of Therapeutics", Ch.1, p. 1.

Goff et al., 1981, "Isolation properties of Moloney Murine Leukemia virus mutants: use of rapid assay for release of virion reverse transcriptase", J. Virol. 62:139–147.

Grosschedl et al., 1984, "Introduction of a μ immunoglobulin gene into the mouse germline: specific expression in lymphoid cells and synthesis of functional antibody", Cell 38:647–658.

Hammer et al.,1987, "Diversity of Alpha–protein gene expression in mice is generated by a combination of separate enhancer elements", Science, 235:53–58.

Hanahan, 1985, "Heritable formation of pancreatic β–cell tumors in transgenic mice expressing recombinant insulin/simian virus 40 oncogenes", Nature 315:115–122.

Kelsey et al., 1987, "Species– and tissue–specific expression of human $\alpha_1$–antitrypsin in transgenic mice", Genes and Dev. 1:161–171.

Kollias et al., 1986, "Regulated expression of Human $^A\gamma$–, β–, and hybrid γβ–globin genes in transgenic mice: manipulation of the developmental expression patterns", Cell 46:89–94.

Krumlauf et al., 1985, "Developmental regulation of α–fetoprotein genes in transgenic mice", Mol. Cell. Biol. 5:1639–1648.

Macdonald, 1987, "Expression of the pancreatic elastase I genes in transgemic mice", Hepatology 7:42S–51S.

Magram et al., 1985, "Developmental regulation of a clothed adult β–globulin gene in transgenic mice", Nature 315:338–340.

Mason et al., 1986, "The hypogonadal mouse: reproductive functions restored by gene therapy", Science 234:1372–1378.

Matthews et al., 1987, "Interaction between the human T–cell lymphotropic virus type $III_B$ envelope glycoprotein gp120 and the surface antigen CD4:role of carbohydrate in binding and cell fusion", PNAS 84:5424–5428.

Olson et al., 1993, "Concepts and progress in the development of mimetics", J. Me. Chem. 36:3049.

Ornitz et al., 1986, "Elastase I promoter directs expression of human growth hormone and SV40 T antigen genes to pancreatic acinar cells in transgenic mice", Cold Spring Harbor Symp. Quant. Biol. 50:399–409.

Pinkert al., 1987, "An albumin enhancer located 10Kb upstream functions along with it promoter to direct efficient, liver–specific expression in transgenic mice", Genes and Dev. 1:268–276.

Popovic et al., 1984, "Detection, Isolation, and continuous production of cytopathic retrovirus (HTLV–III) from patients with AIDS and Pre–AIDS", Science 224:497–508.

Readhead et al., 1987, "Expression of a myelin basic protein gene in transgenic shiverer mice: correction of the dysmyelinating phenotype", Cell 48:703–712.

Rimsky & Matthews, 1998, "Determinants of human immunodeficiency virus type 1 resistance to gp41–derived inhibitory peptides", J. Virol. 72:986–993.

Shani M., 1985, "Tissue–specific expression of rat myosin light chain 2 gene in transgenic mice", Nature, 314:283–286.

Swift et al., 1984, "Tissue–specific expression of the rat pancreatic elastase I gene in transgenic mice", Cell 38:639–646.

Weislow et al., 1989, "New Soluble–formazan assay for HIV–1 cytopathic effects: application to high–flux screening of synthetic and natural products for AIDS–antiviral activity", J. Natl. Cancer Inst. 81:577–586.

Willey, 1988, "In vitro mutagenesis identifies a region within the envelope gene of the human immunodeficiency virus that is critical for infectivity", J. Virol. 62:139–147.

Sigma Chemical Company, Biochemicals Organic Compounds For Research And Diagnostic Reagents, 1994, p. 1864.

* cited by examiner

| PHARMACOKINETIC PARAMETERS | T20BQ1 | T1249A1 |
|---|---|---|
| DOSE (mg/kg IV) | 2.5 | 2.5 |
| DETECTION METHOD | FLUORESCENCE HPLC | FLUORESCENCE HPLC |
| $T_{1/2\beta}$ (h) | 1.6 | 4.71 |
| $Cl_\beta$ (ml/h) | 27.94 | 9.62 |
| $AUC_{[0-8]}$ (ug/h/ml) | 26.12 | 71.43 |

| Trimeris No. | | | | IP t1/2 | Peptide | HIV-1 Fusion EC-50 ng/ml | RSV Fusion EC-50 ng/ml |
|---|---|---|---|---|---|---|---|
| | | NNMTWMEWDREINNYTSLIHSLIEESQNQQEKNEQELLELDKWASLWNWF | | | | | >20000 |
| HIV-1 T20 | Ac- | | YTSLIHSLIEESQNQQEKNEQELLELDKWASLWNWF | -NH2 | 1.5h | HIV-1 T20 | 3 | |
| HIV-1 T379 | Ac- | | YTSLIHSLIEESQNQQEKNEQELLELDKWASLFN[E]F | -NH2 | 20m | HIV-1 T379 | 3 | |
| SIV T402 | Ac- | | LEENITALLEEAQIQQEKNMYELQKLNSWDVFGNWF | -NH2 | 20m | SIV T402 | 3 | |
| HIV-2 T698 | Ac- | | LEANISQSLEQAQIQQEKNMYELQKLNSWDVF[T]NWL | -NH2 | <20m | HIV-2 T698 | 50 | |
| | | | | | | | | |
| HIV-1 T649 | Ac- | WMEWDREINNYTSLIHSLIEESQNQQEKNEQELLEL | | -NH2 | 20m | HIV-1 T649 | 7 | |
| SIV T391 | Ac- | WQEWERKVDFLEENITALLEEAQIQQEKNMYELQKL | | -NH2 | 20m | SIV T391 | 15 | |
| HIV-2 T856 | Ac- | WQEWEQKVRYLEANISQSLEQAQIQQEKNMYELQKL | | -NH2 | 20m | HIV-2 T856 | 7 | |
| HYBRID T1052 | Ac- | WQEWEQKVRYLEANI[TA]LLEQAQIQQEKN[E]YELQKL | | -NH2 | 20m | HYBRID T1052 | 9 | |
| | | | | IV t1/2 | | | |
| HIV-1 T625 | Ac- | MTWMEWDREINNYTSLIHSLIEESQNQQEKNEQELLELDKWASLWNWF | | -NH2 | >4h | HIV-1 T625 | 7 | |
| HIV-1 T866 | Ac- | DREINNYTSLIHSLIEESQNQQEKNEQELLELDKWASLWNWF | | -NH2 | >4h | HIV-1 T866 | 5 | |
| HIV-1 T867 | Ac- | NNMTWMEWDREINNYTSLIHSLIEESQNQQEKNEQELLELDK | | -NH2 | 20m | HIV-1 T867 | 6 | |

FIG.13A

| HIV-1/SIV/HIV-2 HYBRIDS | | | Hybrid (T1052-like) Core Sequence | | | | IV t1/2 | | |
|---|---|---|---|---|---|---|---|---|---|
| HYBRID T1387 | Ac- | | | TALLEQAQIQQEKNEYELQKLDK | | | -NH2 | <5m | HYBRID T1387 >10000 |
| HYBRID T1388 | Ac- | | | TALLEQAQIQQEKNEYELQKLDK | | | -NH2 | <5m | HYBRID T1388 >10000 |
| HYBRID T1226 | Ac- | WQEWEQKVRYLEAN | | ITALLEQAQIQQEKNEYELQKLIE | | | -NH2 | | HYBRID T1226 4 |
| HYBRID T1227 | Ac- | WQEWEQKVRYLEAN | | ITALLEQAQIQQEKNEYELQKLDK | WASLWNWF | | -NH2 | | HYBRID T1227 7 |
| HYBRID T1248 | Ac- | NNMT | | ITALLEQAQIQQEKNEYELQKLDK | WASLWNWF | | -NH2 | | HYBRID T1248 6 |
| HYBRID T1267 | WNWF | WQEWDREI | SNYTSLI | TALLEQAQIQQEKNEYELQKLDK | WASLWNWF | | -NH2 | | HYBRID T1267 3 |
| HYBRID T1269 | Ac- | WQEWDREI | SNYTSLI | TALLEQAQIQQEKNEYELQKLDE | | | -NH2 | | HYBRID T1269 3 |
| HYBRID T1311 | Ac- | WQEWEREI | SAYTSLI | TALLEQAQIQQEKNEYEKII | | WEWF | -NH2 | | HYBRID T1311 53 |
| HYBRID T1314 | Ac- | WQEWEREI | SAYTSLI | TALLEQAQIQQEKNEYEKII | | WEWF | -NH2 | | HYBRID T1314 30 |
| HYBRID T1312 | Ac- | WQEWEREI | SAYTSLI | TALLEQAQIQQEKNEYE LQK LIE | | WEWF | -NH2 | | HYBRID T1312 12 |
| HYBRID T1313 | Ac- | WQEWEREI | | TALLEQAQIQQEKNEYE LQK LIE | | WEWF | -NH2 | | HYBRID T1313 5 |
| HYBRID T1275 | Ac- | WQEWDREI | | TALLEQAQIQQEKNEYELQKLE | | WEWF | -NH2 | | HYBRID T1275 6 |
| HYBRID T1276 | Ac- | WQEWDREI | | TALLEQAQIQQEKNEYELQKLDK | WASLWEWF | | -NH2 | | HYBRID T1276 7 |
| HYBRID T1277 | Ac- | WQEWEREI | | TALLEQAQIQQEKNEYEKII | | WEWF | -NH2 | 1h | HYBRID T1277 3 |
| HYBRID T1278 | Ac- | WQEWEREI | | TALLEQAQIQQEKNEYELQKLIE | | WEWF | -NH2 | 2.5h | HYBRID T1278 6 |
| HYBRID T1279 | Ac- | WQEWEREI | | TALLEQAQIQQEKNEYELQKLDE | | WEWF | -NH2 | | HYBRID T1279 3 |
| HYBRID T1280 | Ac- | WQEWEREI | | TALLEQAQIQQEKNEYELQKLDK | WASLWEWF | | -NH2 | | HYBRID T1280 7 |
| HYBRID T1247 | Ac- | WQEWEQKI | | TALLEQAQIQQEKNEYELQKLDK | WASLWEWF | | -NH2 | 4.7h | HYBRID T1247 1 |
| HYBRID T1249 | Ac- | WQEWEQKI | | TALLEQAQIQQEKNEYELQKLAK | WASLWEWF | | -NH2 | | HYBRID T1249 2 |
| HYBRID T1353 | Ac- | WQEWEQKI | | TALLEQAQIQQEKTEYELQKLAK | WAGLWEWF | | -NH2 | | HYBRID T1353 2 |
| HYBRID T1330 | Ac- | WQEWEQKI | | TALLEQAQIQQEKIEYELQKLAE | WASLWEWF | | -NH2 | | HYBRID T1330 28 3544 |
| HYBRID T1331 | Ac- | WQEWEQKI | | TALLEQAQIQQEKAEYELQKLAE | WASLWEWF | | -NH2 | | HYBRID T1331 30 11136 |
| HYBRID T1332 | Ac- | WQEWEQKI | | TALLEQAQIQQEKAEYELQKLAK | WASLWEWF | | -NH2 | | HYBRID T1332 18 |
| HYBRID T1333 | Ac- | WQEWEQKI | | TALLEQAQIQQEKAEYELQKLAE | WASLWAWF | | -NH2 | | HYBRID T1333 33 |
| HYBRID T1334 | Ac- | WQEWEQKI | | TALLEQAQIQQEKAEYELQKLAE | WASLWAWF | | -NH2 | | HYBRID T1334 35 |
| HYBRID T1347 | Ac- | WQEWEQKI | | TALLEQAQIQQEKAEYELQKLAE | WAGLWAWF | | -NH2 | | HYBRID T1347 8 3819 |
| HYBRID T1350 | Ac- | WQEWEQKI | | TALLEQAQIQQEKAEYELQKLAE | WAGLWAWF | | -NH2 | | HYBRID T1350 6 4516 |
| HYBRID T1348 | Ac- | WQEWEQKI | | TALLEQAQIQQEKAEYELQKLAE | WASLWAW | | -NH2 | | HYBRID T1348 7 5255 |

FIG.13B

| | | | |
|---|---|---|---|
| HYBRID T1351 Ac- | W Q E W E Q K I | T A L L E Q A Q I Q Q E K N E Y E L Q K L A E W A G L W A W | -NH2 |
| HYBRID T1349 Ac- | W Q E W E Q K I | T A L L E Q A Q I Q Q E K A E Y E L Q K L A E W A S L W A W | -NH2 |
| HYBRID T1352 Ac- | W Q E W E Q K I | T A L L E Q A Q I Q Q E K A E Y E L Q K L A E W A G L W A W | -NH2 |
| HYBRID T1339 Ac- | W Q E W E Q K I | T A L L E Q A Q I Q Q E K I I E Y E L Q K L D K W E W F | -NH2 |
| HYBRID T1293 Ac- | W Q E W E Q K I | T A L L E Q A Q I Q Q E K I I E Y E L Q K L I I E W E W F | -NH2 |
| HYBRID T1337 Ac- | W Q E W E Q K I | T A L L E Q A Q I Q Q E K G E Y E L Q K L I I E W E W F | -NH2 |
| HYBRID T1338 Ac- | W Q E W E Q K I | T A L L E Q A Q I Q Q E K I I E Y E L Q K L I I K W E W F | -NH2 |
| HYBRID T1294 Ac- | W Q E W E Q K I | T A L L E Q A Q I Q Q E K I I E Y E L Q K L I I E W A S L W E W F | -NH2 |
| HYBRID T1309 Ac- | W Q E W E Q K I | T A L L E Q A Q I Q Q E K I I K Y E L Q K L I I K W A S L W E W F | -NH2 |
| HYBRID T1281 Ac- | W Q E W E | T A L L E Q A Q I Q Q E K N E Y E L Q K L D E W E W F | -NH2 |
| HYBRID T1282 Ac- | W Q E W E | T A L L E Q A Q I Q Q E K N E Y E L Q K L I I E W E W F | -NH2 |
| HYBRID T1283 Ac- | W Q E W E | T A L L E Q A Q I Q Q E K I I E Y E L Q K L D E W E W F | -NH2 |
| HYBRID T1284 Ac- | W Q E W E | T A L L E Q A Q I Q Q E K I I E Y E L Q K L I I E W E W F | -NH2 |
| HYBRID T1295 Ac- | W Q E W E | T A L L E Q A Q I Q Q E K I I E Y E L Q K L I I E W A S L W E W F | -NH2 |

| | | | |
|---|---|---|---|
| RSV T67 Ac- | | D E F D A S I S Q V N E K I N Q S L A F I R K S D E L L | -NH2 |
| RSV T786 Ac- | V Y P S D E Y D A S I S Q V N E E I N Q A L A Y I R K A D E L L E N V | | -NH2 |

T67 Active Core Sequence

HIV-1/HIV-2/RSV HYBRIDS

| | | | |
|---|---|---|---|
| HYBRID T1138 Ac- | Y

FIG.13D

HIV-1/HIV-2/RSV HYBRIDS

T786 Active Core Sequence

| ID | N-term | Variable | Core | C-term | C-term2 | Half-life | Name | Value |
|---|---|---|---|---|---|---|---|---|
| T1474 | Ac- | | DEYDASISQVNEKINQALAYIREADEL | | | | T1474 | |
| T1475 | Ac- | | DEYDASISQVNEEINQALAYIREADEL | | | | T1475 | |
| HYBRID T1285 | Ac- | WQEWDREI | DEYDASISQVNEKINQALAYIREADEL | WEWF | -NH2 | | HYBRID T1285 | 1800 |
| HYBR

HYBRID POLYPEPTIDES WITH ENHANCED PHARMACOKINETIC PROPERTIES

This application is a continuation-in-part of application Ser. No. 09/315,304, filed May 20, 1999, now U.S. Pat. No. 6,348,568, which is a continuation-in-part of application Ser. No. 09/082,279, filed May 20, 1998, now U.S. Pat. No. 6,258,782, the entire contents of each of which is incorporated herein by reference in its entirety.

The Sequence Listing for this application is on duplicate compact discs labeled "Copy 1" and "Copy 2". Copy 1 and Copy 2 each contain only one file named "7872067c.APP" which was created on Jun. 20, 2001 and is 701,145 bytes. The entire contents of each of the compact discs is incorporated herein by reference.

1. INTRODUCTION

The present invention relates to enhancer peptide sequences originally derived from various retroviral envelope (gp41) protein sequences that enhance the pharmacokinetic properties of any core polypeptide to which they are linked. The invention is based, in part, on the discovery that hybrid polypeptides comprising the enhancer peptide sequences linked to a core polypeptide possess enhanced pharmacokinetic properties such as increased half life. The invention further relates to novel anti-fusogenic and/or antiviral, peptides, including ones that contain such enhancer peptide sequences, and methods for using such peptides. The invention further relates to methods for enhancing the pharmacokinetic properties of any core polypeptide through linkage of the enhancer peptide sequences to the core polypeptide. The core polypeptides to be used in the practice of the invention can include any pharmacologically useful peptide that can be used, for example, as a therapeutic or prophylactic reagent. In a non-limiting embodiment, the invention is demonstrated by way of example wherein a hybrid polypeptide comprising, for example, an HIV core polypeptide linked to enhancer peptide sequences, is shown to be a potent, non-cytotoxic inhibitor of HIV-1, HIV-2 and SIV infection. Additionally, the enhancer peptide sequences of the invention have been linked to a respiratory syncytial virus (RSV) core polypeptide and a luteinizing hormone receptor (LH-RH) core polypeptide. In each instance, the hybrid polypeptide was found to possess enhanced pharmacokinetic properties, and the RSV hybrid polypeptide exhibited substantial anti-RSV activity.

2. BACKGROUND OF THE INVENTION

Polypeptide products have a wide range of uses as therapeutic and/or prophylactic reagents for prevention and treatment of disease. Many polypeptides are able to regulate biochemical or physiological processes to either prevent disease or provide relief from symptoms associated with disease. For example, polypeptides such as viral or bacterial polypeptides have been utilized successfully as vaccines for prevention of pathological diseases. Additionally, peptides have been successfully utilized as therapeutic agents for treatment of disease symptoms. Such peptides fall into diverse categories such, for example, as hormones, enzymes, immunomodulators, serum proteins and cytokines.

For polypeptides to manifest their proper biological and therapeutic effect on the target sites, the polypeptides must be present in appropriate concentrations at the sites of action. In addition, their structural integrity must generally be maintained. Therefore, the formulation of polypeptides as drugs for therapeutic use is directed by the chemical nature and the characteristics of the polypeptides, such as their size and complexity, their conformational requirements, and their often complicated stability, and solubility profiles. The pharmacokinetics of any particular therapeutic peptide is dependent on the bioavailability, distribution and clearance of said peptide.

Since many bioactive substances, such as peptides and proteins, are rapidly destroyed by the body, it is critical to develop effective systems for maintaining a steady concentration of peptide in blood circulation, to increase the efficacy of such peptides, and to minimize the incidence and severity of adverse side effects.

3. SUMMARY OF THE INVENTION

The present invention relates, first, to enhancer peptide sequences originally derived from various retroviral envelope (gp41) protein sequences i.e., HIV-1, HIV-2 and SIV, that enhance the pharmacokinetic properties of any core polypeptide to which they are linked. The invention is based on the surprising result that when the disclosed enhancer peptide sequences are linked to any core polypeptide, the resulting hybrid polypeptide possesses enhanced pharmacokinetic properties including, for example, increased half life and reduced clearance rate relative to the core polypeptide alone. The present invention further relates to such hybrid polypeptides and core polypeptides, and to novel peptides that exhibit anti-fusogenic activity, antiviral activity and/or the ability to modulate intracellular processes that involve coiled-coil peptide structures. Among such peptides are ones that contain enhancer peptide sequences.

Core polypeptides can comprise any peptides which may be introduced into a living system, for example, any peptides capable of functioning as therapeutic, prophylactic or imaging reagents useful for treatment or prevention of disease or for diagnostic or prognostic methods, including methods in vivo imaging. Such peptides include, for example, growth factors, hormones, cytokines, angiogenic growth factors, extracellular matrix polypeptides, receptor ligands, agonists, antagonists or inverse agonists, peptide targeting agents, such as imaging agents or cytotoxic targeting agents, or polypeptides that exhibit antifusogenic and/or antiviral activity, and peptides or polypeptides that function as antigens or immunogens including, for example, viral and bacterial polypeptides.

The invention further relates to methods for enhancing the pharmacokinetic properties of any core polypeptide through linkage of the core polypeptide to the enhancer peptide sequences to form hybrid polypeptides.

The invention still further relates to methods for using the peptides disclosed herein, including hybrid polypeptides containing enhancer peptide sequences. For example, the methods of the invention include methods for decreasing or inhibiting viral infection, e.g., HIV-1, HIV-2, RSV, measles, influenza, parainfluenza, Epstein-Barr, and hepatitis virus infection, and/or viral-induced cell fusion events. The enhancer peptide sequences of the invention can, additionally, be utilized to increase the in vitro or ex-vivo half-life of a core polypeptide to which enhancer peptide sequences have been attached, for example, enhancer peptide sequences can increase the half life of attached core polypeptides in cell culture or cell or tissue samples.

The invention is demonstrated by way of examples wherein hybrid polypeptides containing an HIV core polypeptide linked to enhancer peptide sequences are shown to exhibit greatly enhanced pharmacokinetic properties and act as a potent, non-cytotoxic inhibitors of HIV-1, HIV-2 and SIV infection. The invention is further demonstrated by examples wherein hybrid polypeptides containing an RSV core polypeptide or a luteinizing hormone polypeptide are shown to exhibit greatly enhanced pharmacokinetic properties. In addition, the RSV hybrid polypeptide exhibited substantial anti-RSV activity.

3.2. DEFINITIONS

Peptides, polypeptides and proteins are defined herein as organic compounds comprising two or more amino acids covalently joined, e.g., by peptide amide linages. Peptides, polypeptide and proteins may also include non-natural amino acids and any of the modifications and additional amino and carboxyl groups as are described herein. The terms "peptide," "polypeptide" and "protein" are, therefore, utilized interchangeably herein.

Peptide sequences defined herein are represented by one-letter symbols for amino acid residues as follows:

A (alanine)
R (arginine)
N (asparagine)
D (aspartic acid)
C (cysteine)
Q (glutamine)
E (glutamic acid)
G (glycine)
H (histidine)
I (isoleucine)
L (leucine)
K (lysine)
M (methionine)
F (phenylalanine)
P (proline)
S (serine)
T (threonine)
W (tryptophan)
Y (tyrosine)
V (valine)
X (any amino acid)

"Enhancer peptide sequences" are defined as peptides having the following consensus amino acid sequences: "WXXWXXXI", "WXXWXXX", "WXXWXX", "WXXWX", "WXXW", "WXXXWXWX", "XXXWXWX", "XXWXWX", "XWXWX", "WXWX", "WXXXWXW", "WXXXWX", "WXXXW", "IXXXWXXW", "XXXWXXW", "XXWXXW", "XWXXW", "XWXWXXXW", "XWXWXXX", "XWXWXX", "XWXWX", "XWXW", "WXWXXXW", or "XWXXXW", wherein X can be any amino acid, W represents tryptophan and I represents isoleucine. As discussed below, the enhancer peptide sequences of the invention also include peptide sequences that are otherwise the same as the consensus amino acid sequences but contain amino acid substitutions, insertions or deletions but which do not abolish the ability of the peptide to enhance pharmacokinetic properties of a core peptide to which it is linked relative to the pharmacokinetic properties of the core polypeptide alone.

"Core polypeptide" as used herein, refers to any polypeptide which may be introduced into a living system and, thus, represents a bioactive molecule, for example any polypeptide that can function as a pharmacologically useful peptide for treatment or prevention of disease.

"Hybrid polypeptide" as used herein, refers to any polypeptide comprising an amino, carboxy, or amino and carboxy terminal enhancer peptide sequence and a core polypeptide. Typically, an enhancer peptide sequence is linked directly to a core polypeptide. It is to be understood that an enhancer peptide can also be attached to an intervening amino acid sequence present between the enhancer peptide sequence and the core peptide.

"Antifusogenic" and "anti-membrane fusion," as used herein, refer to a peptide's ability to inhibit or reduce the level of fusion events between two or more structures e.g., cell membranes or viral envelopes or pili, relative to the level of membrane fusion which occurs between the structures in the absence of the peptide.

"Antiviral," as used herein, refers to the peptide's ability to inhibit viral infection of cells via, e.g., cell fusion or free virus infection. Such infection can involve membrane fusion, as occurs in the case of enveloped viruses, or another fusion event involving a viral structure and a cellular structure, e.g., fusion of a viral pilus and bacterial membrane during bacterial conjugation).

4. BRIEF DESCRIPTION OF DRAWINGS

Figure 7A:
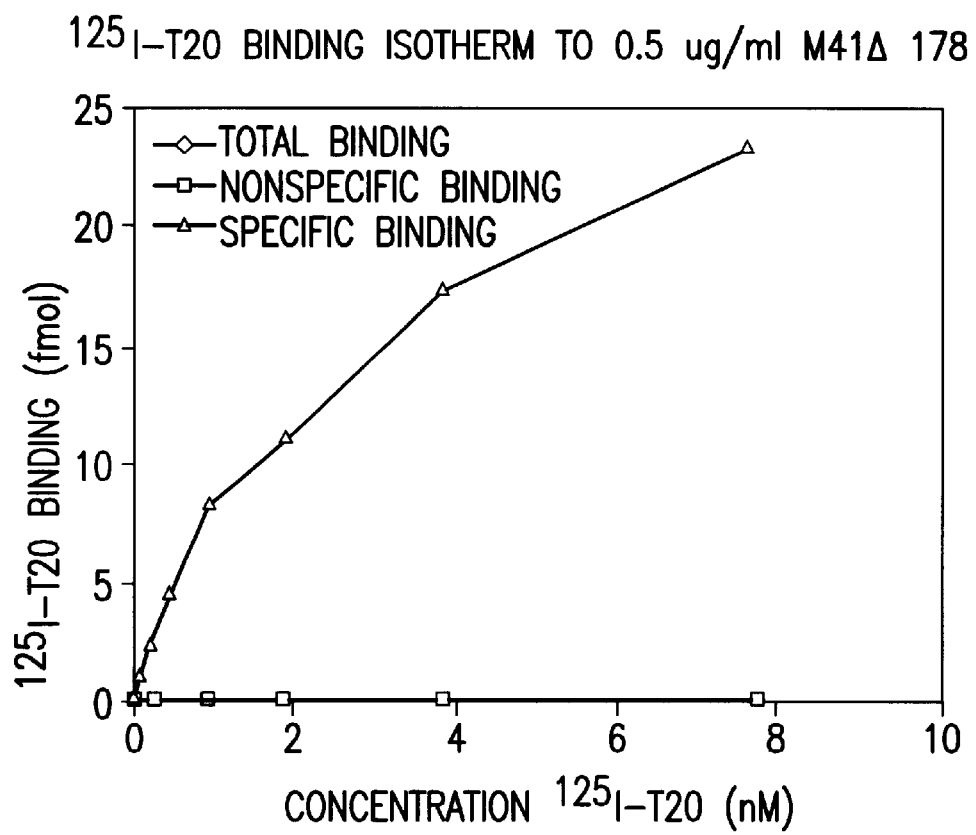
Figures 1, 7A:
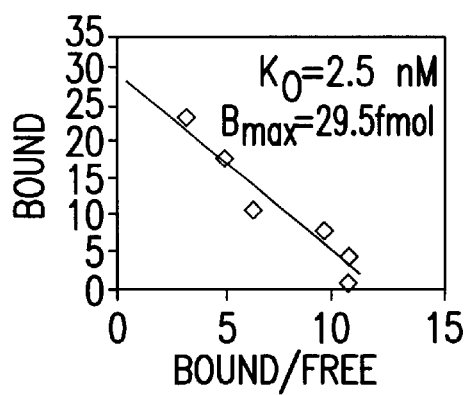

FIG. 1. Hybrid polypeptides. Enhancer peptide sequences derived from putative N-terminal and C-terminal interactive regions are depicted linked to a generic core polypeptide. Conserved enhancer peptide sequences are shaded. It is to be noted that the enhancer peptide sequences indicated may be used either as N-terminal, C-terminal, or N- and C-terminal additions. Further, the enhancer peptide sequences can be added to a core polypeptide in forward or reverse orientation, individually or in any of the possible combinations, to enhance pharmacokinetic properties of the peptide.

Figures 2A, 2B:
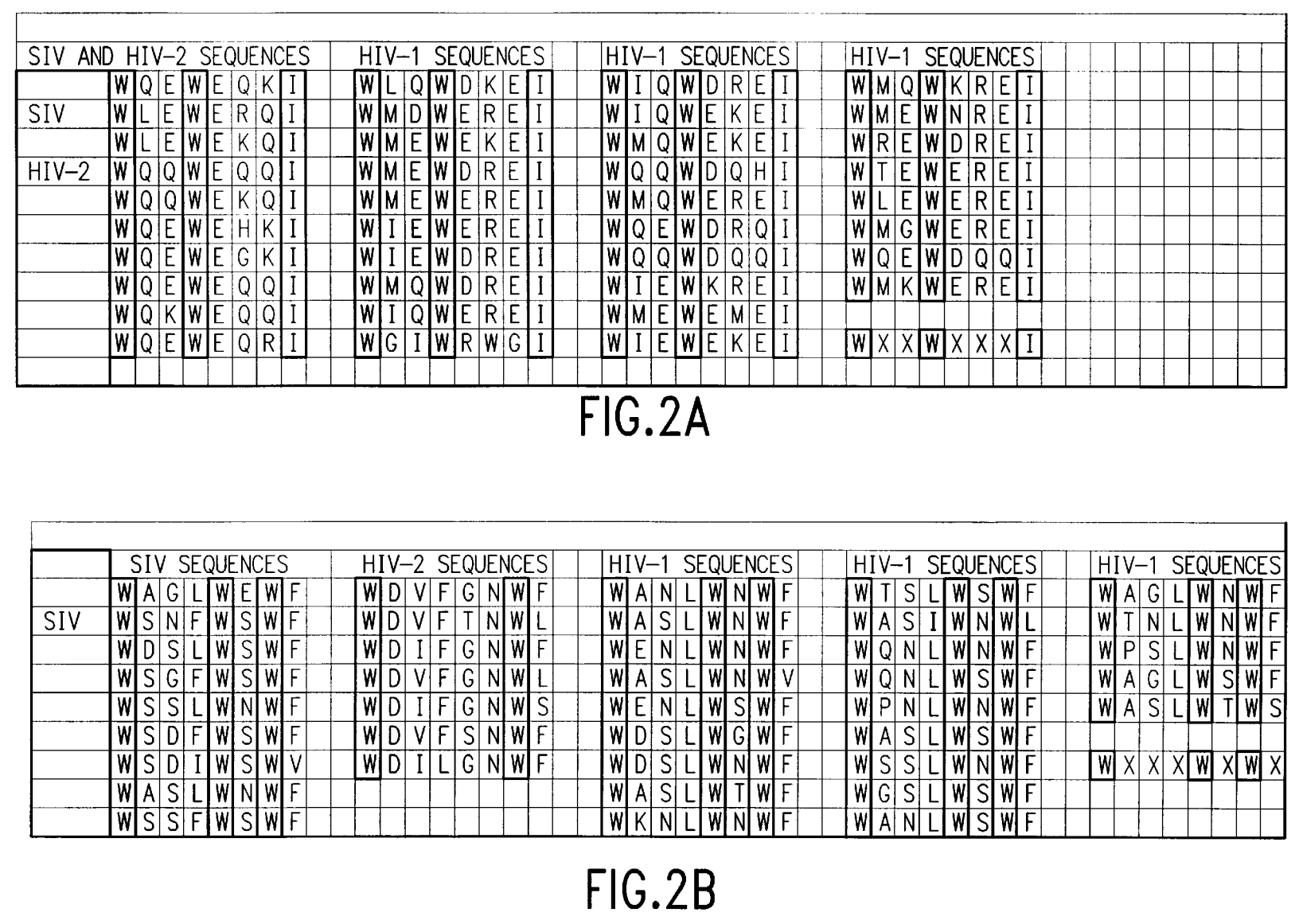

FIG. 2A. Enhancer peptide sequences derived from various envelope (gp41) protein sequences, representing the N-terminal interactive region observed in all currently published isolate sequences of HIV-1, HIV-2 and SIV (SEQ ID NOS:1590–1628). The final sequence "WXXWXXXI" (SEQ ID NO:1628) represents a consensus sequence.

FIG. 2B. Enhancer peptide sequence variants derived from various envelope (gp41) protein sequences, representing the C-terminal interactive region observed in all currently published isolate sequences of HIV-1, HIV-2 and SIV (SEQ ID NOS:1629–1668). The final sequence "WXXXWXWX"(SEQ ID NO:1668) represents a consensus sequence.

FIG. 3. Comparison of HIV-1 titres in tissues of HIV-1 9320 infected SCID-HUPBMC mice as measured by P24 Levels in HuPBMC co-culture assays. The figure shows a comparison of in vivo T20 and T1249 viral inhibition.

FIGS. 4A–4B. Plasma pharmacokinetic profile of T1249 vs. T1387 core control in CD-rats following IV injection for up to 2 hours (FIG. 4A) and 8 hours (FIG. 4B). The T1387 polypeptide is a core polypeptide and the T1249 polypeptide is the T1387 core linked to specific enhancer peptide sequences.

FIG. 5. Plasma pharmacokinetic profile of T1249 vs. T20 control in CD-rats following IV administration. The T1249 polypeptide is a hybrid polypeptide of a core polypeptide (T1387) linked to enhancer peptide sequences. T20: n=4; T1249: n=3.

FIG. 6. Comparison of T20/T1249 Anti-HIV-1/IIIb activity and cytotoxicity.

FIGS. 7A–7B. Direct Binding of T20 and T1249 to gp41 construct M41Δ178. Saturation binding to M41Δ178 (a gp41 ectodomain fusion protein lacking the T20 amino acid sequence) by $^{125}$I-T20 (FIG. 7A) and $^{125}$I-T1249 (FIG. 7B) immobilized in microtitre plates at 0.5 μg/ml is depicted. Linear inverse Scatchard plots for T20 (FIG. 7A–1) and T1249 (FIG. 7B–1) suggest that each ligand binds to a homogeneous class of sites.

Figure 8A:
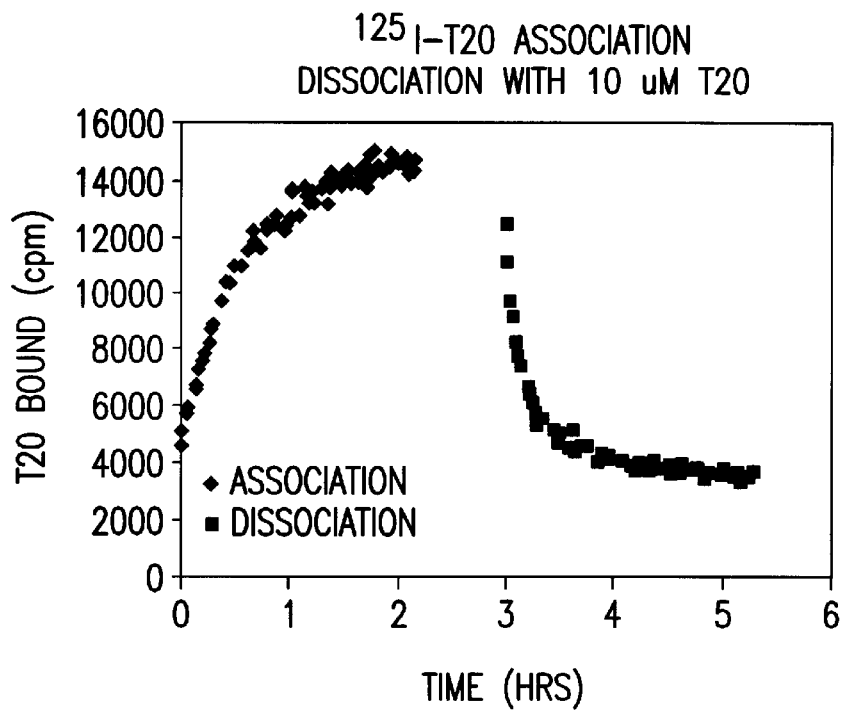
Figure 8B:
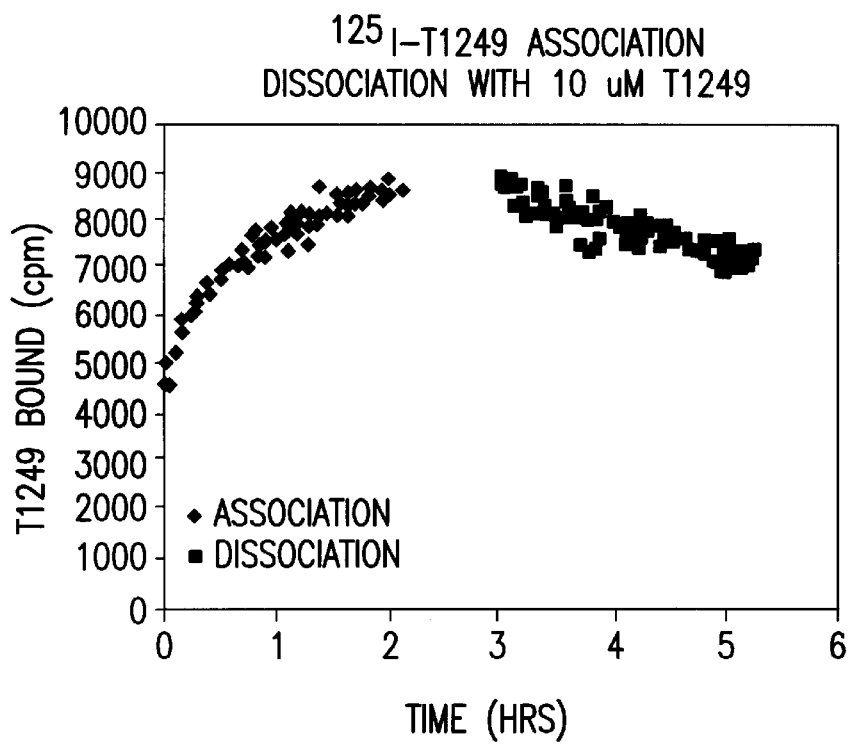

FIGS. 8A–8B. Time Course of T1249 Association/Dissociation. The results demonstrate that $^{125}$I-T20 (FIG. 8A) and $^{125}$I-T1249 (FIG. 8B) have similar binding affinities of 1–2 nM. Initial on and off rates for $^{125}$I-T1249 were significantly slower than those of $^{125}$I-T20. Dissociation of bound radioligand was measured following the addition of unlabeled peptide to a final concentration of 10 μm in 1/10 total assay volume.

Figure 9A:
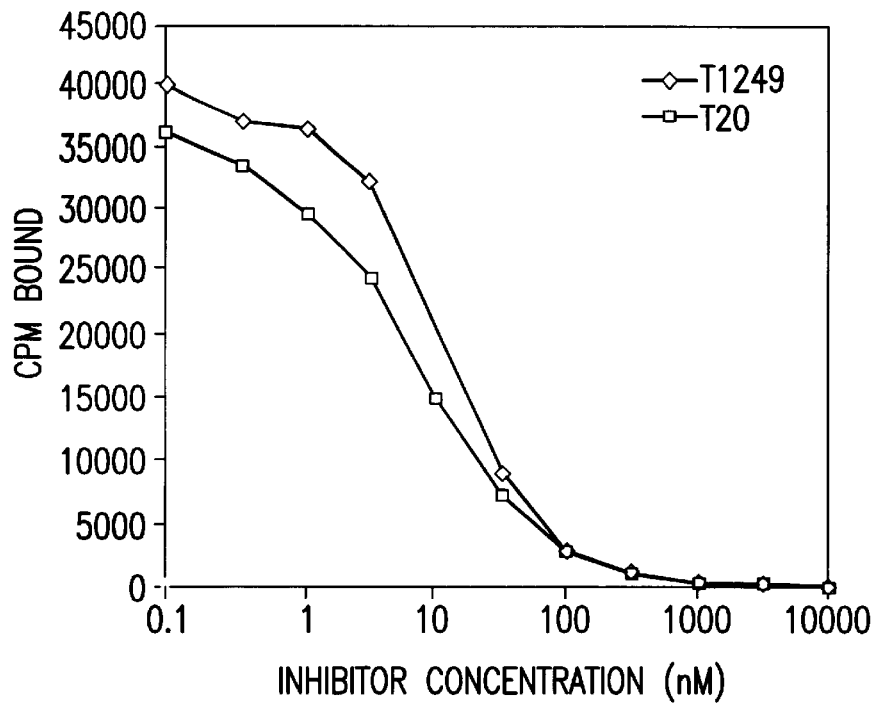
Figure 9B:
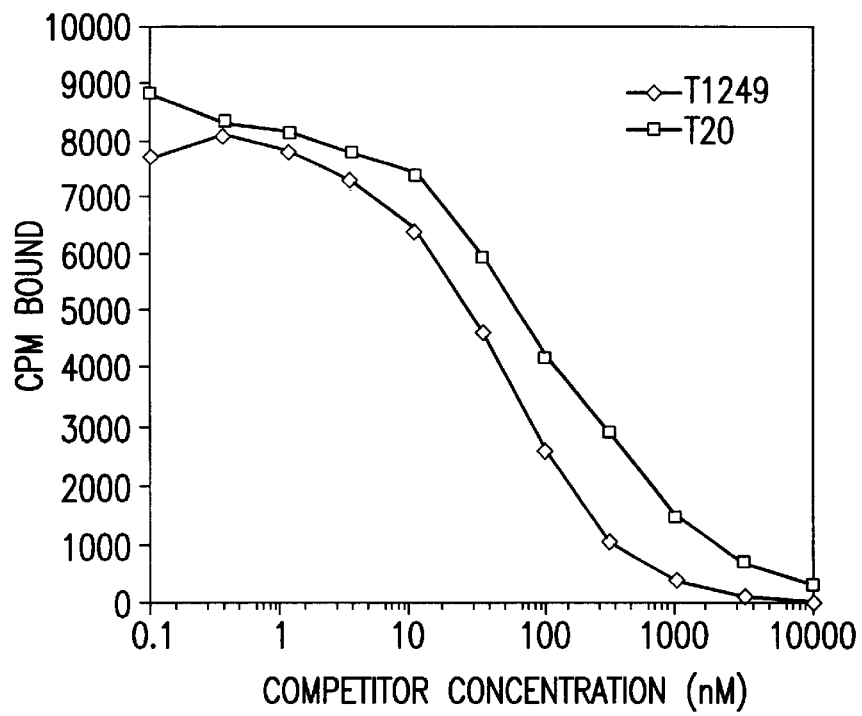

FIGS. 9A–9B. Competition Binding Assay for T20 and T1249 Binding to M41Δ178. Unlabeled T1249 and T20 were titrated in the presence of a single concentration of either $^{125}$I-T20 (FIG. 9A) or $^{125}$I-T1249 (FIG. 9B). Ligand was added just after the unlabeled peptide to initiate the incubation.

Figure 10A:
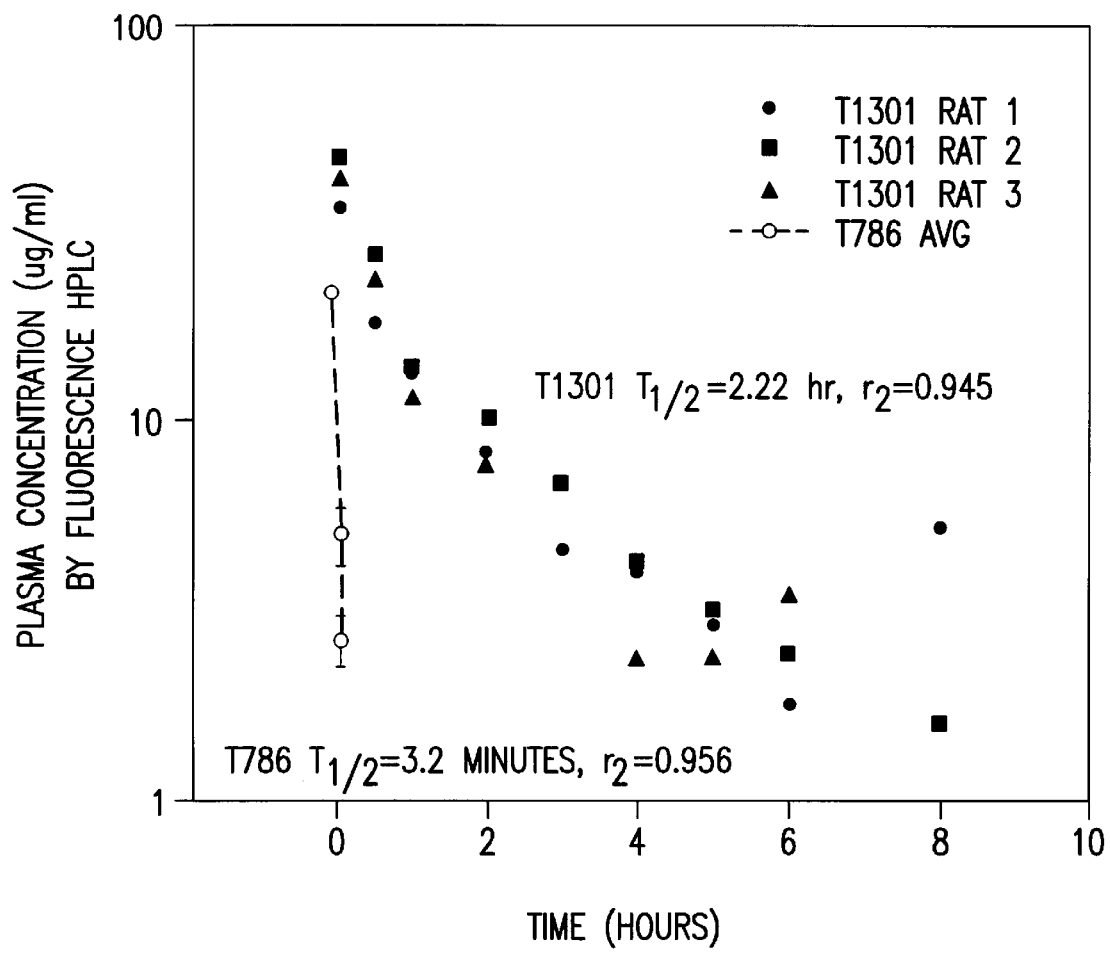
Figure 10B:
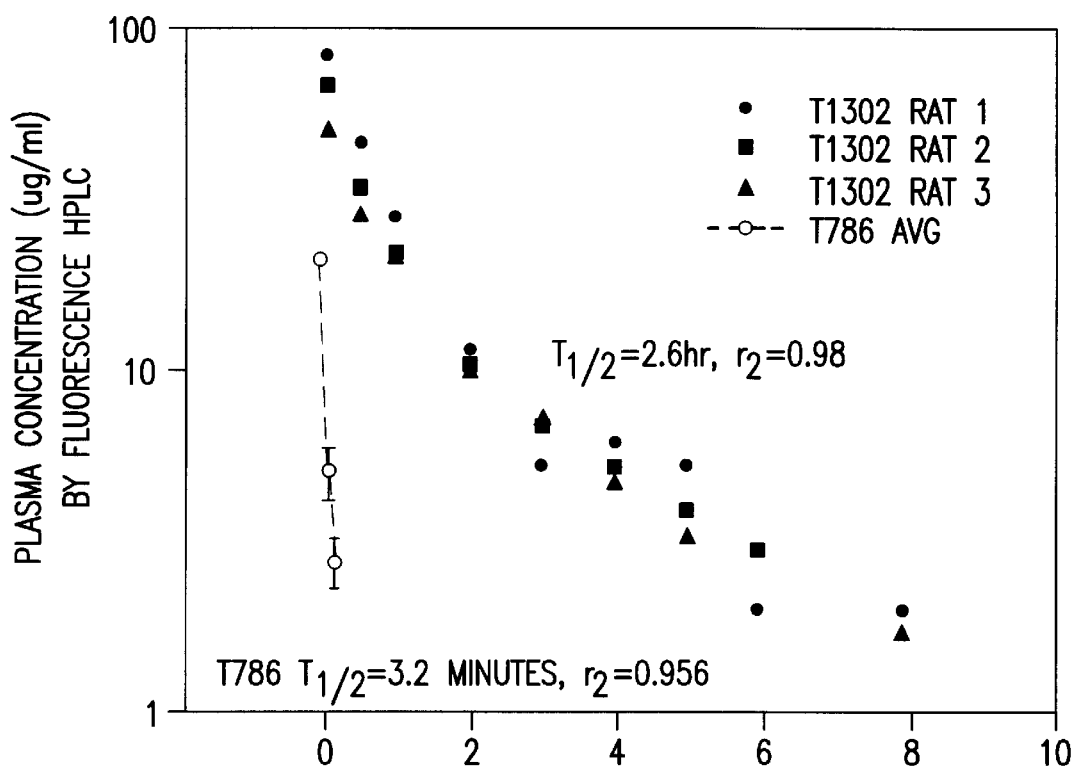

FIGS. 10A–10B. Plasma pharmacokinetic profile of RSV hybrid polypeptides T1301 (FIG. 10A) and T1302 (FIG. 10B) vs. T786 in CD rats.

Figure 11A:
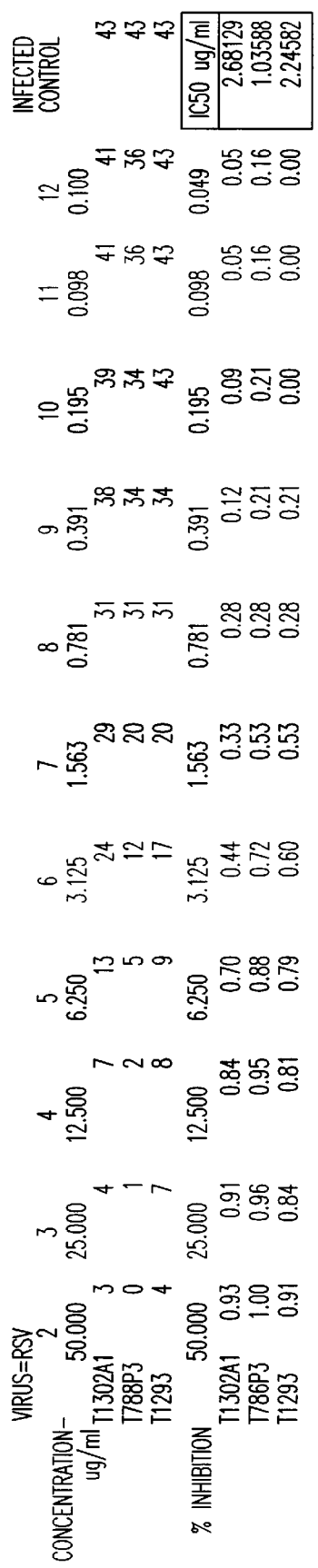
Figure 11A:
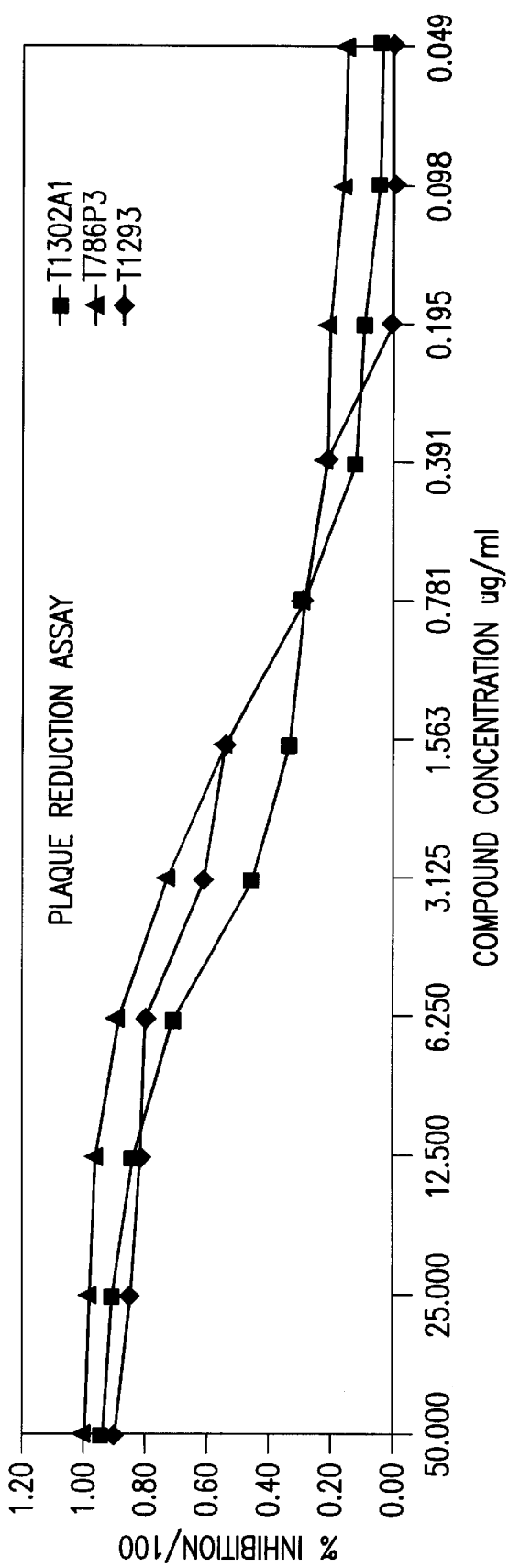

FIG. 11A. Plaque Reduction Assay. Hybrid polypeptide T1293 is capable of inhibiting RSV infection with an $IC_{50}$ 2.6 μg/ml.

Figure 11B:
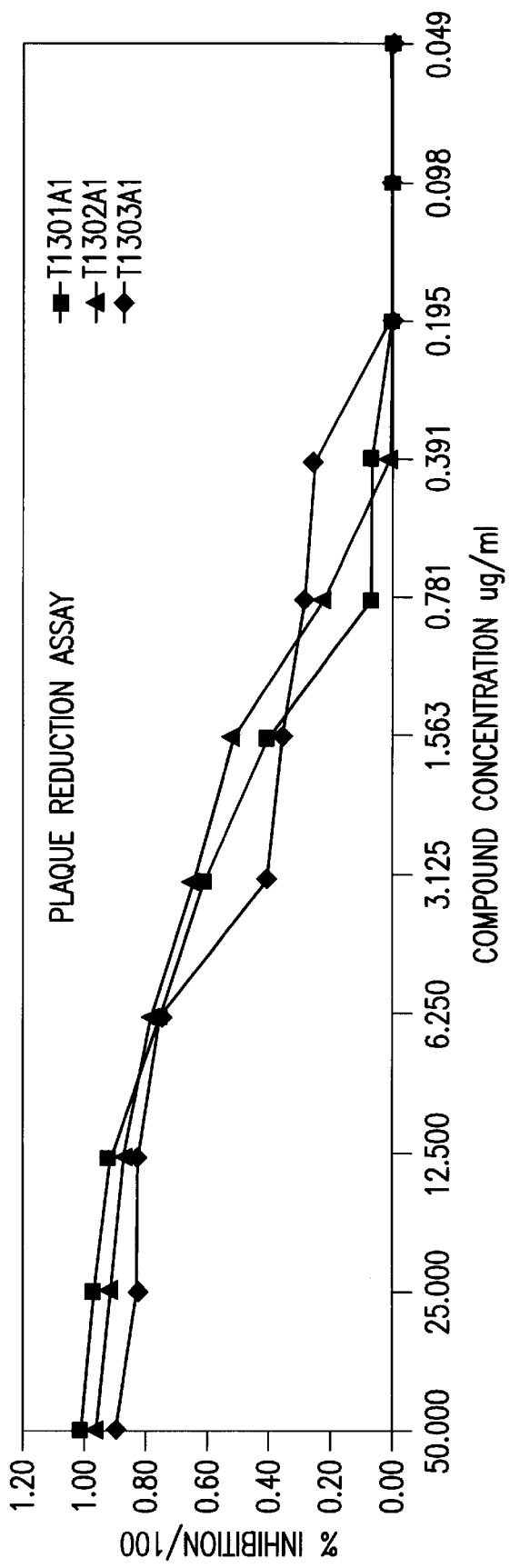

FIG. 11B. Plaque Reduction Assay demonstrates the ability of RSV Hybrid Polypeptides T1301, T1302 and T1303 to inhibit RSV infection.

Figure 12A:
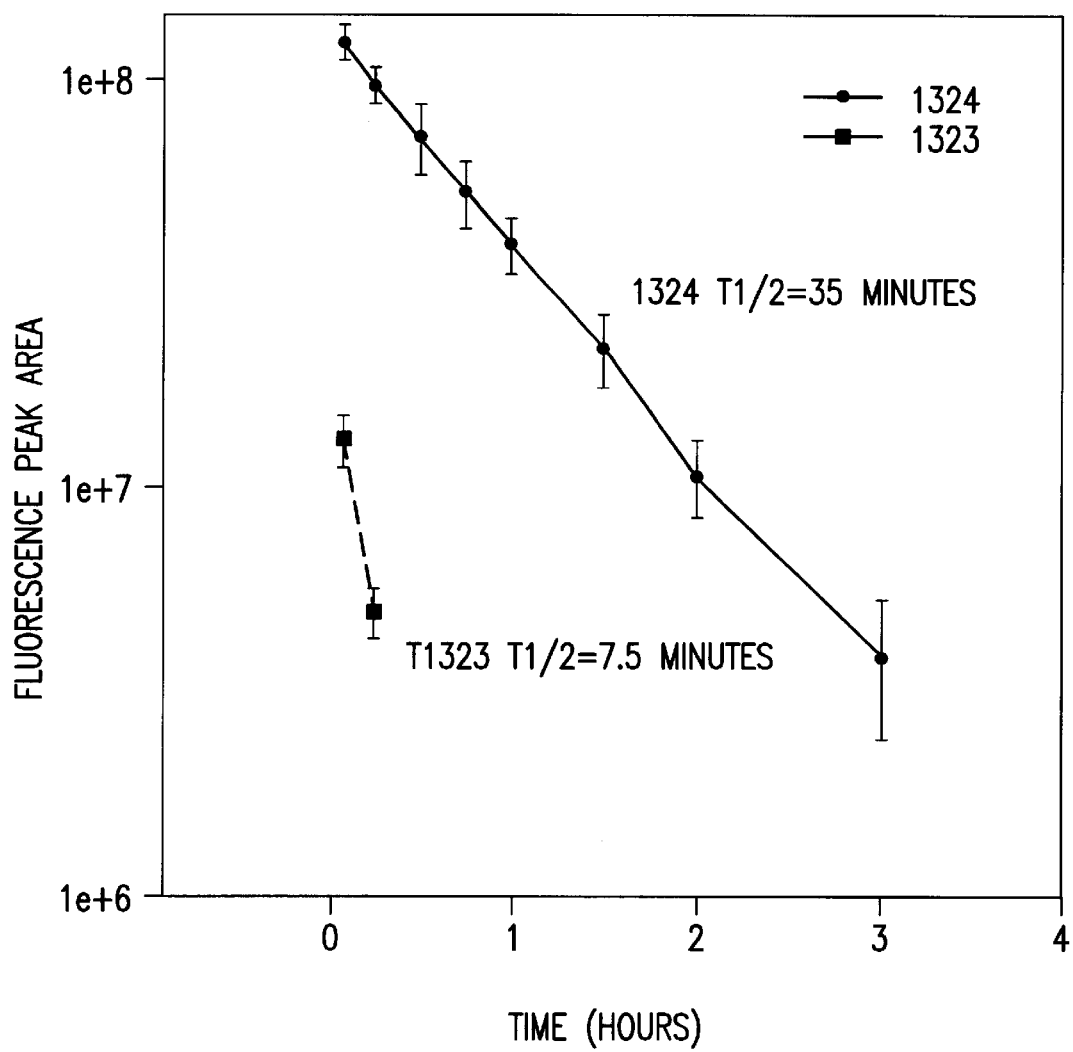
Figure 12B:
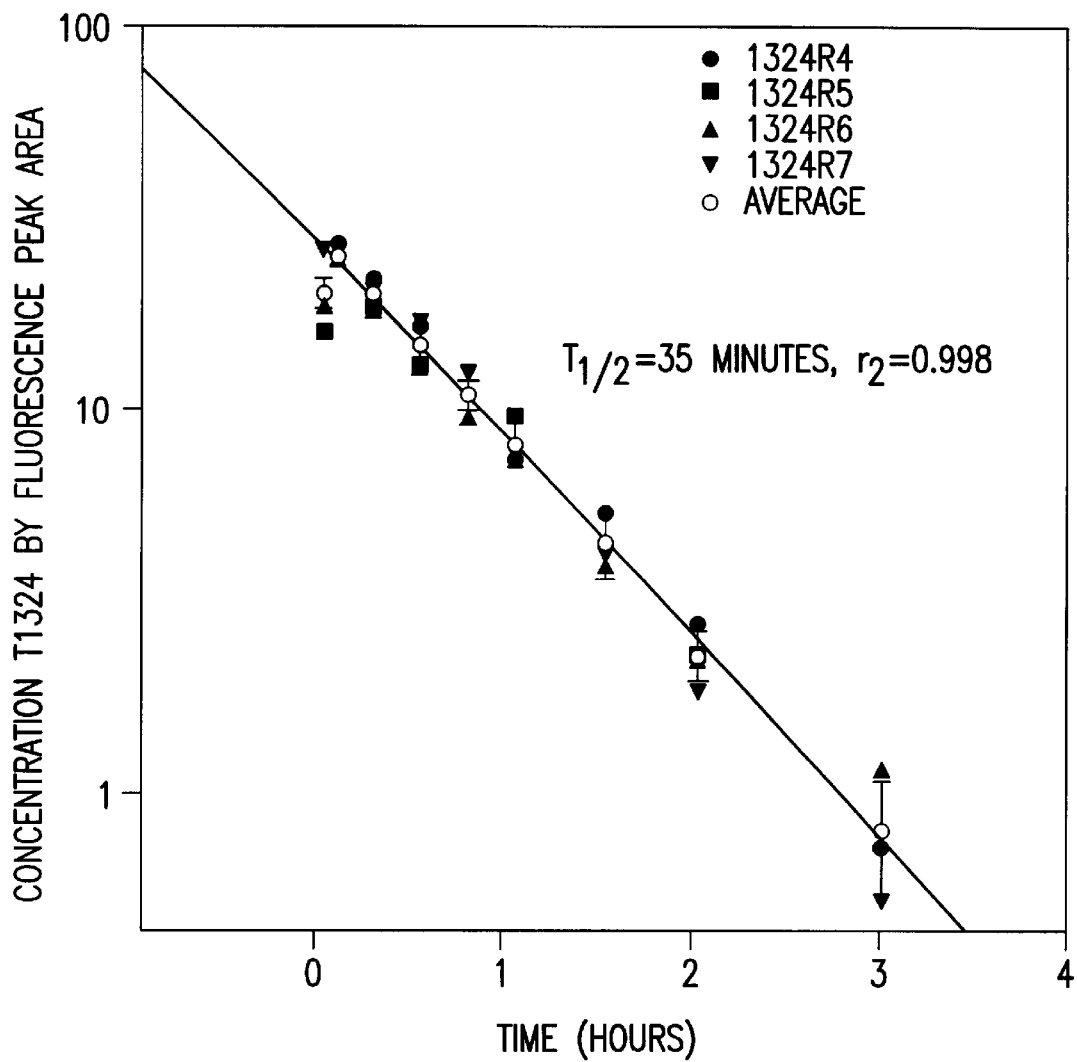

FIGS. 12A–12B. Plasma pharmacokinetic profile of luteinizing hormone hybrid polypeptide T1324 vs. T1323 in CD male rats. The T1323 polypeptide is a luteinizing hormone core polypeptide and the T1324 polypeptide is a hybrid polypeptide comprising a core polypeptide linked to enhancer peptide sequences.

FIGS. 13A–13D. Hybrid polypeptide sequences derived from various core polypeptides. Core polypeptide sequences (SEQ ID NOS: 1513, 15, 375, 397, 1514, 572, 386, 739, 1515, 547, 746, 747, 1205, 1206, 1052, 1053, 1070, 1089, 1091, 1132, 1135, 1133, 1134, 1097, 1099, 1100, 1101, 1102, 1069, 1071, 1171, 1149, 1150, 1151, 1152, 1153, 1165, 1168, 1166, 1169, 1167, 1170, 1158, 1115, 1156, 1157, 1116, 1130, 1103, 1104, 1105, 1106, 1117, 63, 692, 970, 986, 969, 987, 988, 989, 1001, 1416, 1415, 1107, 1110, 1108, 1111, 1109, 1112, 1113, 1114, 1122, 1123, 1124, 1143, 1146, 1147, 1148, 1144, 1145, 1172, and 1173, in the order that sequences appear in the table) are depicted in boxes. The amino and carboxy terminal sequences extending from the boxed core sequences represent enhancer peptide sequences.

Figure 14A:
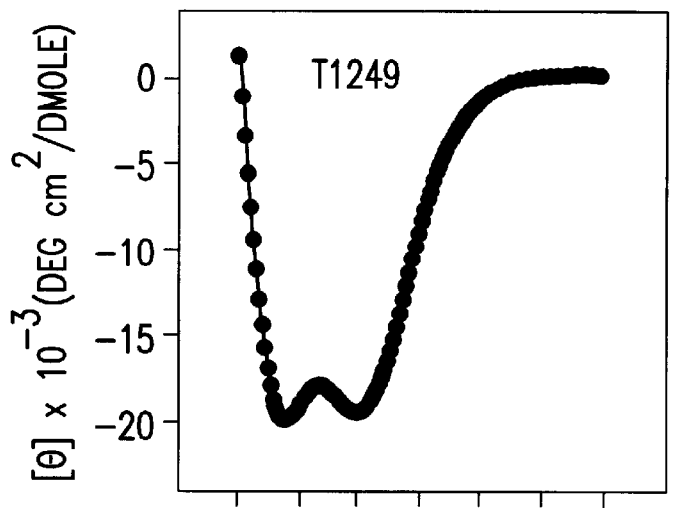
Figure 14B:
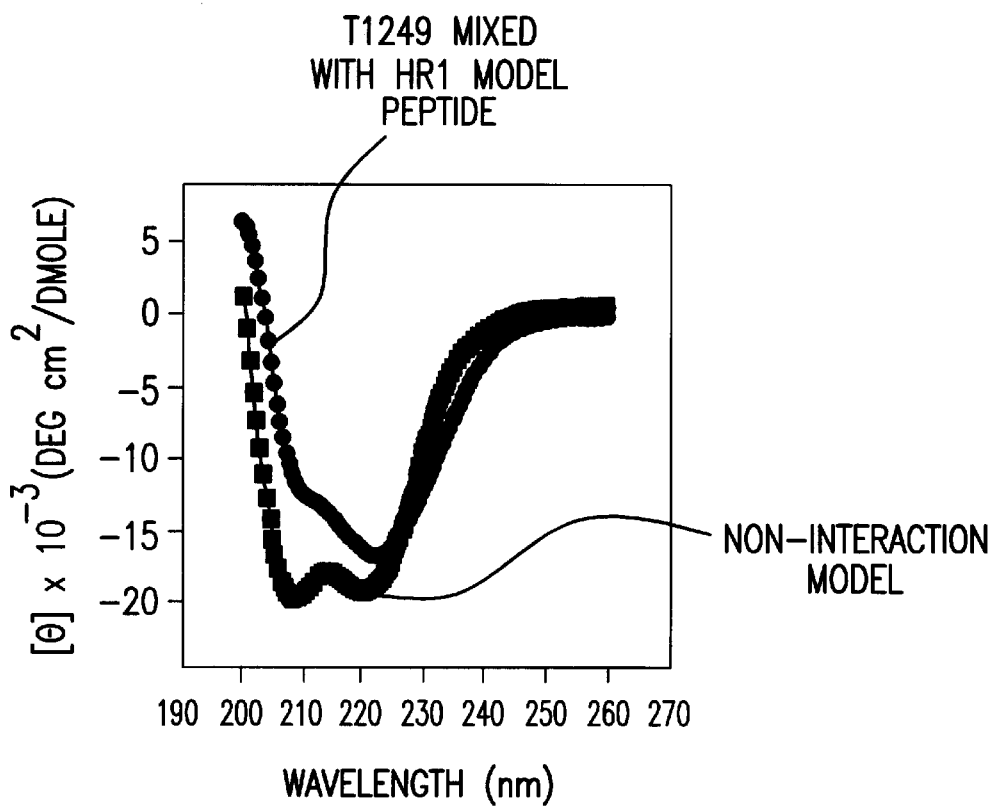

FIGS. 14A–B. Circular Dichroism (CD) spectra for T1249 in solution (phosphate buffered saline, pH 7) alone (10 μM at 1° C.; FIG. 14A) and in combination with a 45-residue peptide from the gp41 HR1 binding domain (T1346); the closed square (■) represents a theoretical CD spectrum predicted for a "non-interaction model" whereas the actual CD spectra are represented by the closed circle (●).

Figure 15:
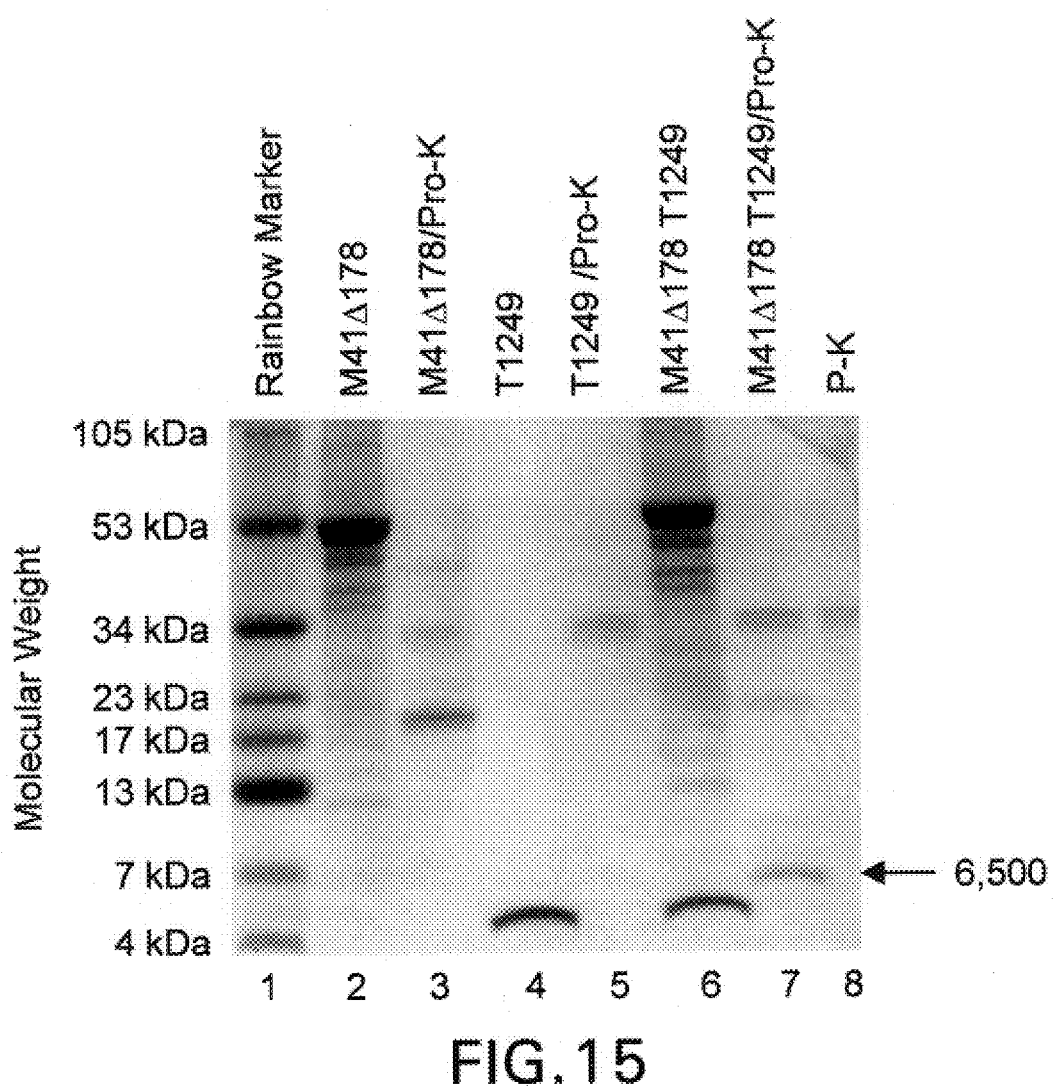

FIG. 15. Polyacrylamide gel electrophoresis showing T1249 protection of the gp41 construct M41Δ178 from proteinase-K digestion; lane 1: primer marker; lane 2: untreated M41Δ178; lane 3: M41Δ178 incubated with proteinase-K; lane 4: untreated T1249; lane 5: T1249 incubated with proteinase-K; lane 6: M41Δ178 incubated with T1249; lane 7: incubation of T1249 and M41Δ178 prior to addition of proteinase-K.

Figure 16A:
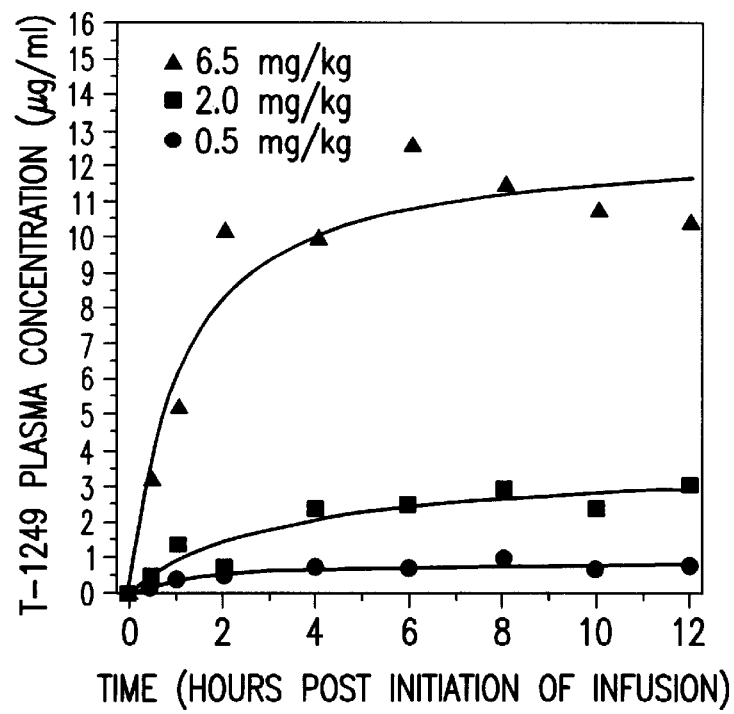
Figure 16B:
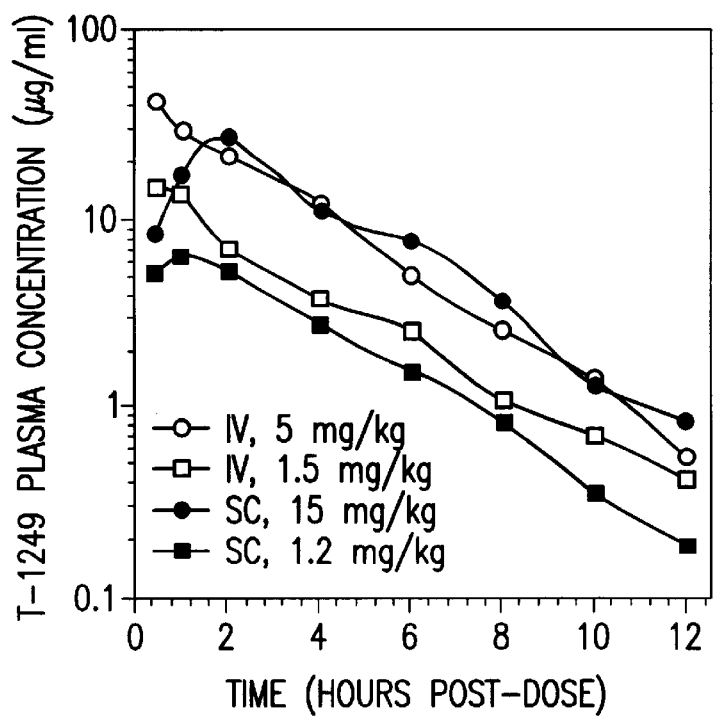
Figure 16C:
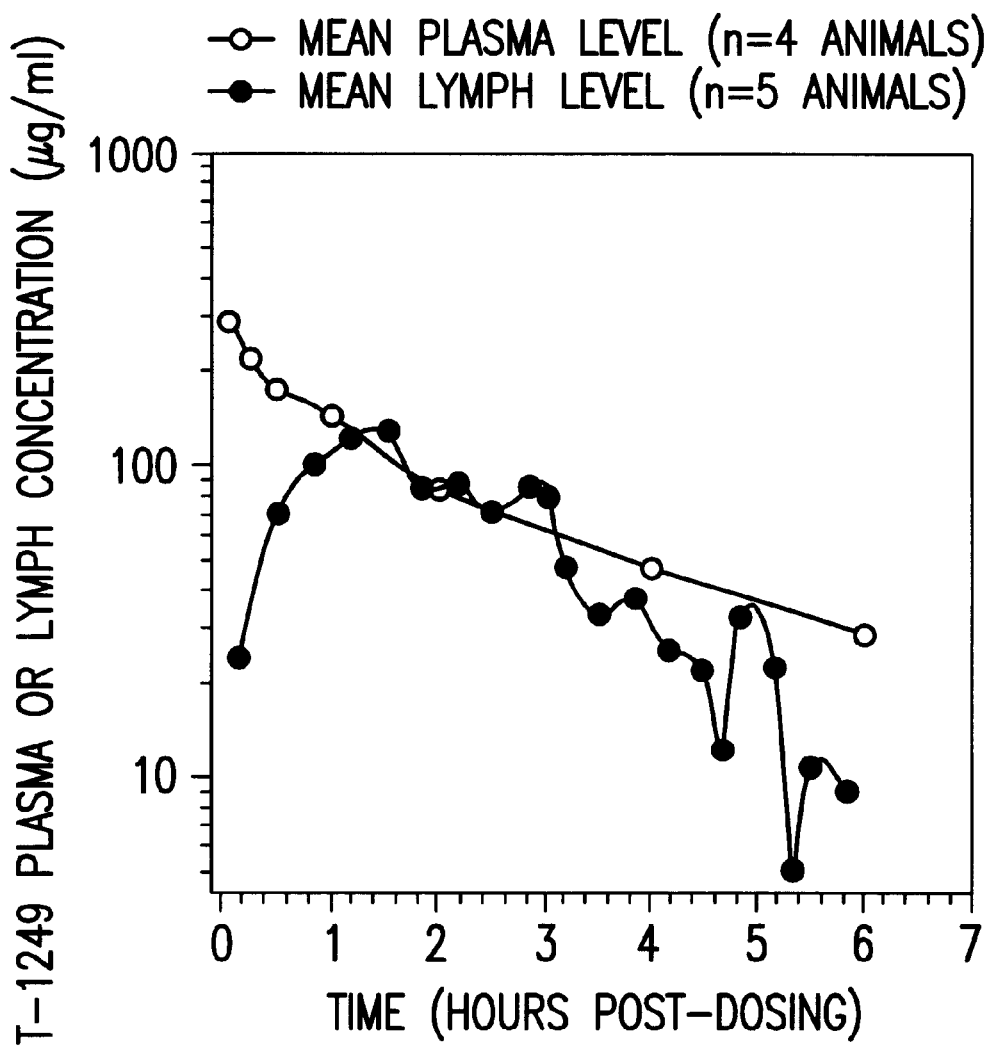

FIGS. 16A–C. Pharmacokinetics of T1249 in Sprague-Dawley albino rats; FIG. 16A: pharmacokinetics of T1249 in a single dose administration by continuous subcutaneous infusion; FIG. 16B: plasma pharmacokinetics of T1249 administered by subcutaneous injection (SC) or intravenous injection (IV); FIG. 16C: kinetic analysis of T1249 in lymph and plasma after intravenous administration.

Figure 17A:
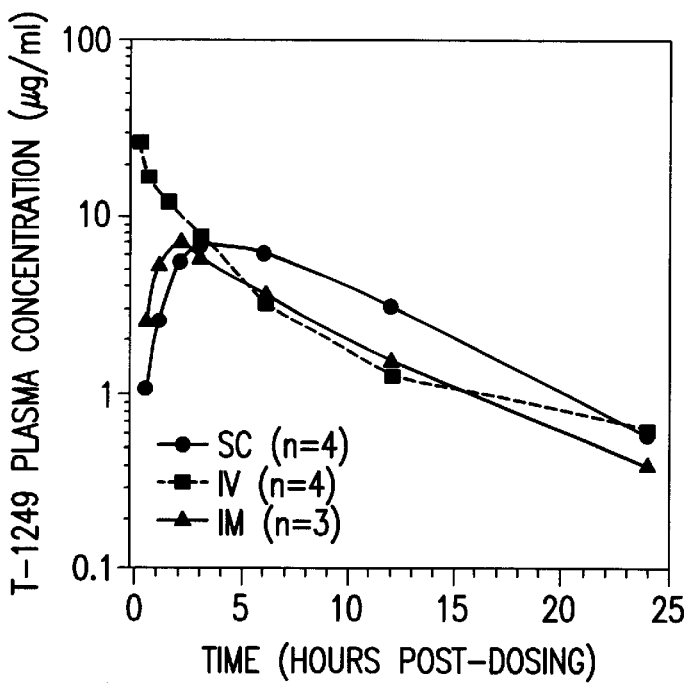
Figure 17B:
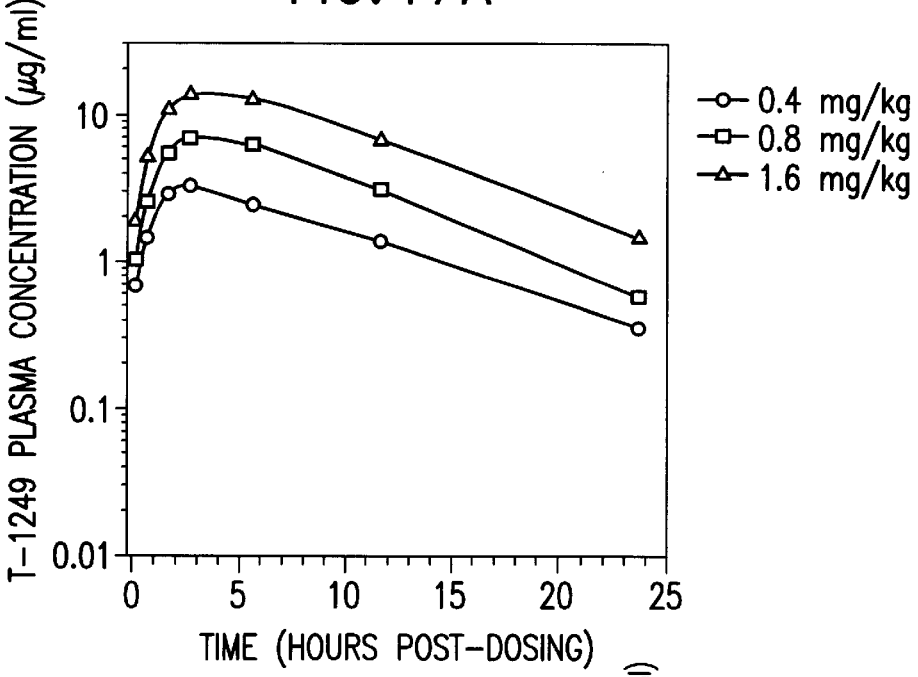
Figures 1, 17B:
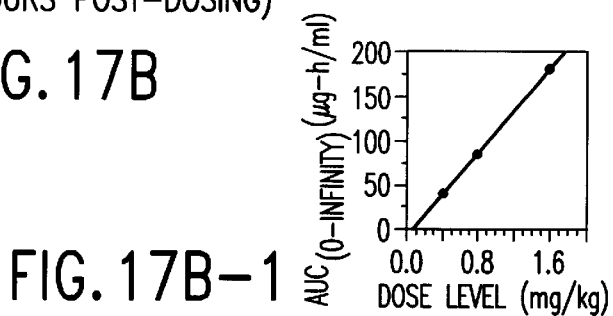

FIGS. 17A–B. Pharmacokinetics of T1249 in cynomolgus monkeys. FIG. 17A: plasma pharmacokinetics of a single 0.8 mg/kg dose of T1249 via subcutaneous (SC), intravenous (IV) or intramuscular (IM) injection; FIG. 17B: plasma pharmacokinetics of subcutaneously administered T1249 at three different dose levels (0.4 mg/kg, 0.8 mg/kg, and 1.6 mg/kg); FIG. 17B–1: results indicate a linear relationship between dose level and pharmacokinetic activity of T1249 in plasma.

Figure 18A:
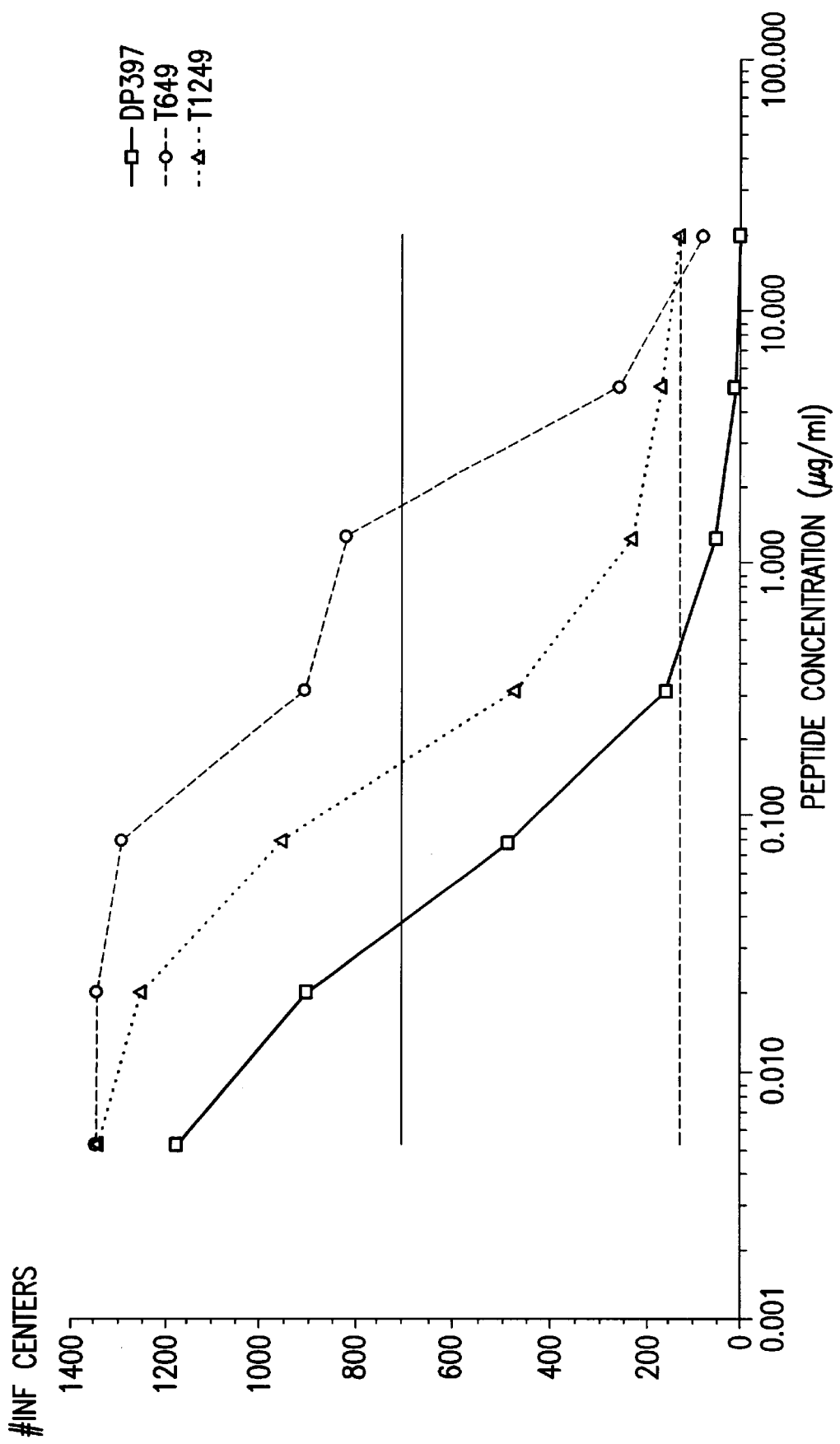
Figure 18B:
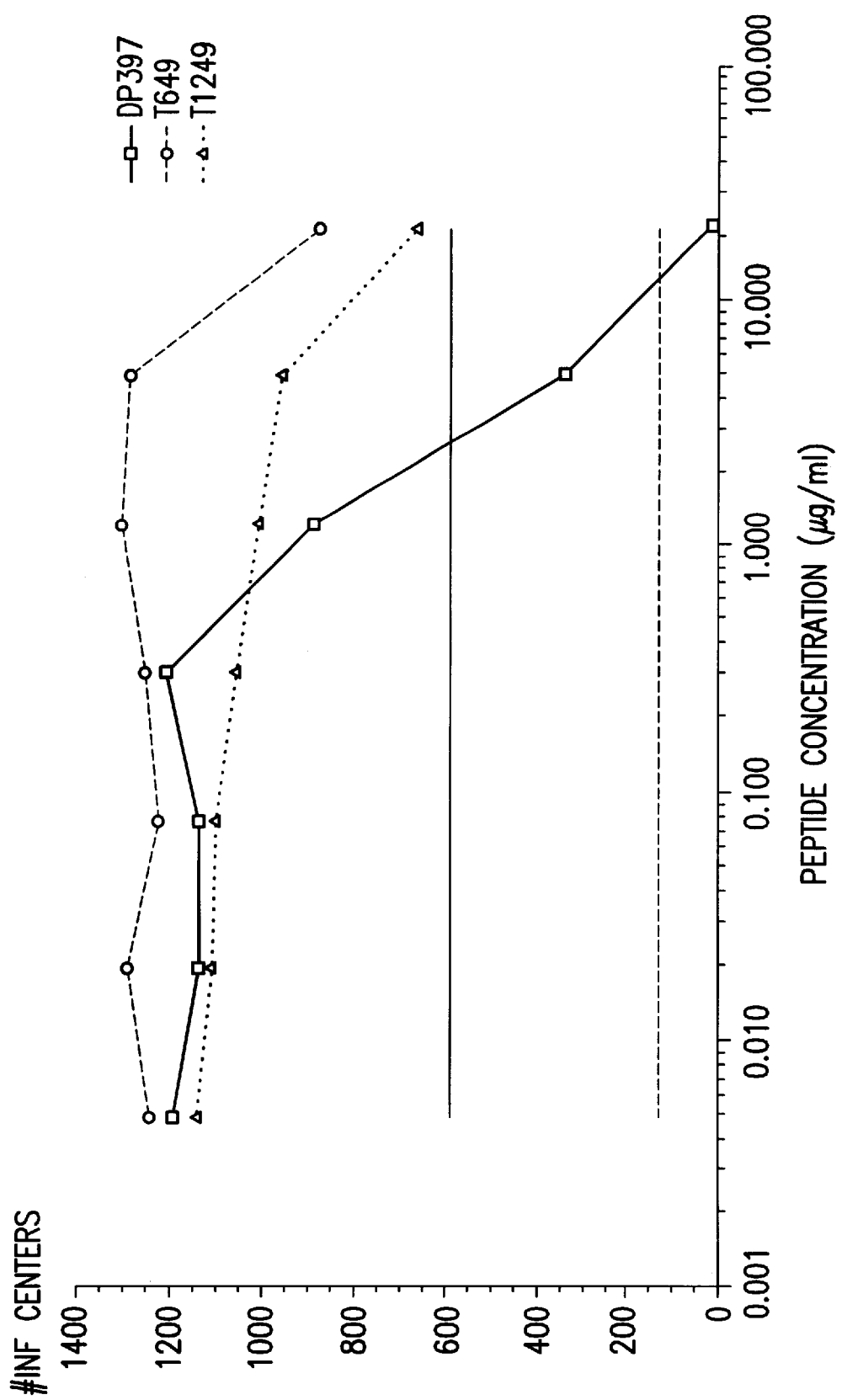
Figure 18C:
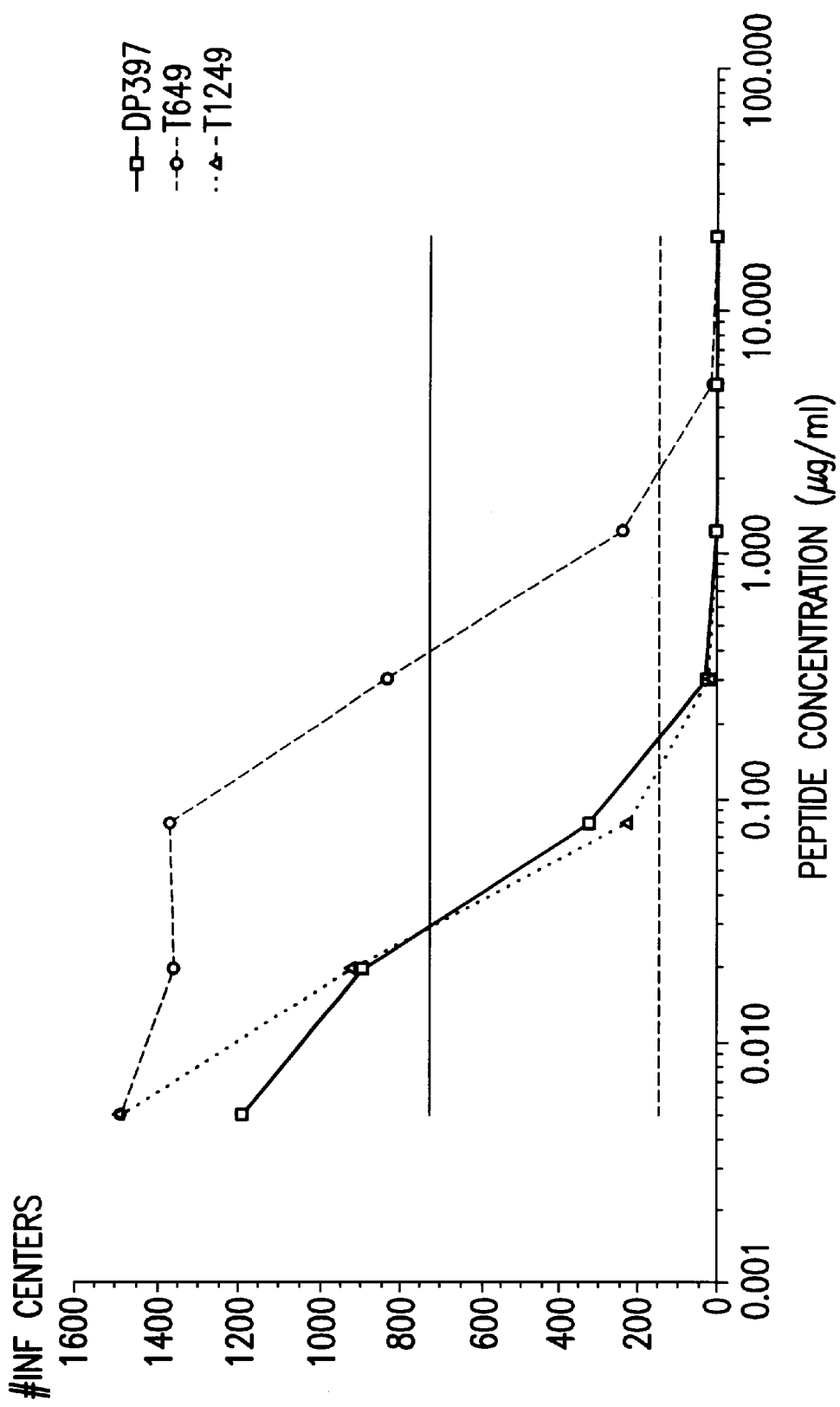
Figure 18D:
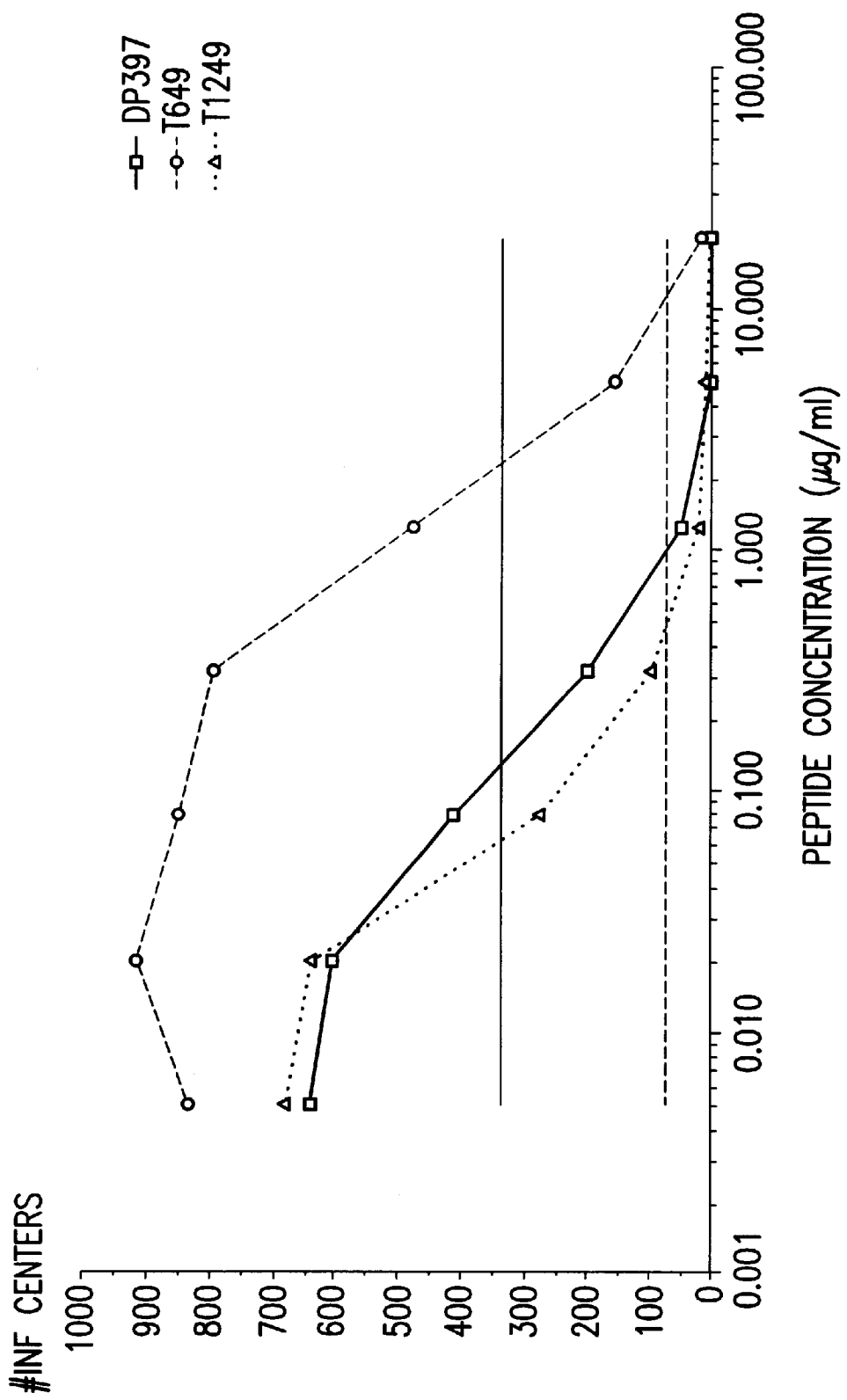

FIGS. 18A–18D. Antiviral activity exhibited by the peptides DP397 (—□—), T649 (---○---) and T1249 (···△···) in various T649 resistant strains of HIV-1, as assayed in a Magi-CCR-5 infectivity assay; solid (upper) and dashed (lower) horizontal lines in each figure indicating levels of 50% and 90% reduction in HIV-1 infection, respectively; FIG. 18A: antiviral activity exhibited by DP397, T649 and T1249 in the HIV-1 strain RF-649; FIG. 18B: antiviral activity exhibited by DP397, T649 and T1249 in the HIV-1 strain DH012–649; FIG. 18C: antiviral activity exhibited by DP397, T649 and T1249 in the HIV-1 strain 3'ETVQQQ; FIG. 18D: antiviral activity exhibited by DP397, T649 and T1249 in the HIV-1 strain SIM-649.

5. DETAILED DESCRIPTION OF THE INVENTION

Described herein are peptide sequences, referred to as enhancer peptide sequences, derived from various retroviral envelope (gp41) protein sequences that are capable of enhancing the pharmacokinetic properties of core polypeptides to which they are linked. Such enhancer peptide sequences can be utilized in methods for enhancing the pharmacokinetic properties of any core polypeptide through linkage of the enhancer peptide sequences to the core polypeptide to form a hybrid polypeptide with enhanced pharmacokinetic properties relative to the core polypeptide alone. The half life of a core peptide to which an enhancer peptide sequence or sequences has been attached can also be increased in vitro. For example, attached enhancer peptide sequences can increase the half life of a core polypeptide when present in cell culture, tissue culture or patient samples, such as cell, tissue, or other samples.

The core polypeptides of the hybrid polypeptides of the invention comprise any peptide which may be introduced into a living system, for example, any peptide that can function as a therapeutic or prophylactic reagent useful for treatment or prevention of disease, or an imaging agent useful for imaging structures in vivo.

Also described herein are peptides, including peptides that contain enhancer peptide sequences, that exhibit anti-fusogenic and/or anti-viral activity. Further described herein are methods for utilizing such peptides, including methods for decreasing or inhibiting viral infection and/or viral induced cell fusion.

5.1. HYBRID POLYPEPTIDES

The hybrid polypeptides of the invention comprise at least one enhancer peptide sequence and a core polypeptide. Preferably, the hybrid polypeptides of the invention comprise at least two enhancer peptide sequences and a core polypeptide, with at least one enhancer peptide present in the hybrid polypeptide amino to the core polypeptide and at least one enhancer peptide sequence present in the hybrid polypeptide carboxy to the core polypeptide.

The enhancer peptide sequences of the invention comprise peptide sequences originally derived from various retroviral envelope (gp 41) protein sequences, including HIV-1, HIV-2 and SIV sequences, and specific variations or modifications thereof described below. A core polypeptide can comprise any peptide sequence, preferably any peptide sequence that may be introduced into a living system, including, for example, peptides to be utilized for therapeutic, prophylactic or imaging purposes.

Typically, a hybrid polypeptide will range in length from about 10 to about 500 amino acid residues, with about 10 to about 100 amino acid residues in length being preferred, and about 10 to about 40 amino acids in length being most preferred.

While not wishing to be bound by any particular theory, the structure of the envelope protein is such that the putative α-helix region located in the C-terminal region of the protein is believed to associate with the leucine zipper region located in the N-terminal region of the protein. Alignment of the N-terminal and C-terminal enhancer peptide sequence gp41 regions observed in all currently published isolate sequences of HIV-1, HIV-2 and SIV identified consensus amino acid sequences.

In particular, the following consensus amino acid sequences representing consensus enhancer peptide sequences were identified (the consensus sequences are listed below in forward and reverse orientations because said enhancer peptide sequences can be utilized either in forward or reverse orientation): "WXXWXXXI", "WXXWXXX", "WXXWXX", "WXXWX", "WXXW", "WXXXWXWX", "XXXWXWX", "XXWXWX", "XWXWX", "WXWX", "W X X X W X W", "W X X X W X", "W X X X W", "IXXXWXXW", "XXXWXXW", "XXWXXW", "XWXXW", "XWXWXXXW", "XWXWXXX", "XWXWXX", "XWXWX", "XWXW", "WXWXXXW", or "XWXXXW", wherein X can be any amino acid, W represents tryptophan and I represents isoleucine. Forward orientations of consensus amino acid sequences are shown in FIGS. 1 and 2.

Typically, an enhancer peptide sequence will be about 4, 5, 6, 7, 8, 9, 10, 11, 12, 13, 14, 15, 16, 17, 18, 19, 20, 21, 22, 23, 24, 25, 26, 27, 28, 29 or 30 amino acid residues in length, with about 4 to about 20 residues in length being preferred, about 4 to about 10 residues in length being more preferred, and about 6 to about 8 residues in length being most preferred.

In a preferred embodiment of the invention, enhancer peptide sequences which may be used to enhance the pharmacokinetic properties of the resultant hybrid polypeptides comprise the specific enhancer peptide sequences depicted in FIGS. 2, 13, and Table 1, below. Among the most preferred enhancer peptide sequences are ones comprising the following amino sequence: "WQEWEQKI" (SEQ ID NO:1129) and "WASLWEWF" (SEQ ID NO:1433).

By way of example and not by way of limitation, Table 1, below, lists amino acid sequences (SEQ ID NOS:1544–1588) that represent preferred embodiments of the enhancer peptide sequences of the enhancer peptide sequences of the invention. It is to be understood that while the forward orientation of these sequences is depicted below, the reverse orientation of the sequences is also intended to fall within the scope of the present invention. For example, while the forward orientation of the enhancer peptide sequence "WMEWDREI" (SEQ ID NO:1544) is depicted below, its reverse orientation, i.e., "IERDWEMW" (SEQ ID NO:1543) is also intended to be included.

TABLE 1

| | |
|---|---|
| WMEWDREI | (SEQ ID NO:1544) |
| WQEWERKV | (SEQ ID NO:1545) |
| WQEWEQKV | (SEQ ID NO:1546) |
| MTWMEWDREI | (SEQ ID NO:1547) |
| NNMTWMEWDREI | (SEQ ID NO:1548) |
| WQEWEQKVRYLEANI | (SEQ ID NO:1549) |
| NNMTWQEWEZKVRYLEANI | (SEQ ID NO:1550) |
| WNWFI | (SEQ ID NO:1551) |
| WQEWDREISNYTSLI | (SEQ ID NO:1552) |
| WQEWEREISAYTSLI | (SEQ ID NO:1553) |
| WQEWDREI | (SEQ ID NO:1554) |
| WQEWEI | (SEQ ID NO:1555) |
| WNWF | (SEQ ID NO:1556) |
| WQEW | (SEQ ID NO:1557) |
| WQAW | (SEQ ID NO:1558) |
| WQEWEQKI | (SEQ ID NO:1559) |
| WASLWNWF | (SEQ ID NO:1560) |
| WASLFNFF | (SEQ ID NO:1561) |
| WDVFTNWL | (SEQ ID NO:1562) |
| WASLWEWF | (SEQ ID NO:1563) |
| EWASLWEWF | (SEQ ID NO:1564) |
| WEWF | (SEQ ID NO:1565) |
| EWEWF | (SEQ ID NO:1566) |
| IEWEWF | (SEQ ID NO:1567) |
| IEWEW | (SEQ ID NO:1568) |
| EWEW | (SEQ ID NO:1569) |
| WASLWEWF | (SEQ ID NO:1570) |
| WAGLWEWF | (SEQ ID NO:1571) |
| AKWASLWEWF | (SEQ ID NO:1572) |
| AEWASLWEWF | (SEQ ID NO:1573) |
| WASLWAWF | (SEQ ID NO:1574) |
| AEWASLWAWF | (SEQ ID NO:1575) |
| AKWASLWAWF | (SEQ ID NO:1576) |
| WAGLWAWF | (SEQ ID NO:1577) |
| AEWAGLWAWF | (SEQ ID NO:1578) |
| WASLWAW | (SEQ ID NO:1579) |
| AEWASLWAW | (SEQ ID NO:1580) |
| WAGLWAW | (SEQ ID NO:1581) |
| AEWAGLWAW | (SEQ ID NO:1582) |
| DKWEWF | (SEQ ID NO:1583) |
| IEWASLWEWF | (SEQ ID NO:1584) |
| IKWASLWEWF | (SEQ ID NO:1585) |
| DEWEWF | (SEQ ID NO:1586) |
| GGWASLWNWF | (SEQ ID NO:1587) |
| GGWNWF | (SEQ ID NO:1588) |

In another preferred embodiment, particular enhancer peptide sequences of the invention comprise the enhancer peptide sequences depicted in FIGS. 2, 13 and Table 1 exhibiting conservative amino acid substitutions at one, two or three positions, wherein said substitutions do not abolish the ability of the enhancer peptide sequence to enhance the pharmacokinetic properties of a hybrid polypeptide relative to its corresponding core polypeptide.

Most preferably, such substitutions result in enhancer peptide sequences that fall within one of the enhancer peptide sequence consensus sequences. As such, generally, the substitutions are made at amino acid residues corresponding to the "X" positions depicted in the consensus amino acid sequences depicted above and in FIGS. 1 and 2. "Conservative substitutions" refer to substitutions with amino acid residues of similar charge, size and/or hydrophobicity/hydrophilicity characteristics as the amino acid residue being substituted. Such amino acid characteristics are well known to those of skill in the art.

The present invention further provides enhancer peptide sequences comprising amino acid sequences of FIGS. 1, 2, 13 and Table 1 that are otherwise the same, but, that said enhancer peptide sequences comprise one or more amino acid additions (generally no greater than about 15 amino acid residues in length), deletions (for example, amino- or terminal-truncations) or non-conservative substitutions which nevertheless do not abolish the resulting enhancer peptide's ability to increase the pharmacokinetic properties of core polypeptides to which they are linked relative to core polypeptides without such enhancer peptide sequences.

Additions are generally no greater than about 15 amino acid residues and can include additions of about 1, 2, 3, 4, 5, 6, 7, 8, 9, 10, 11, 12, 13, 14 or 15 consecutive amino acid residues. Preferably the total number of amino acid residues added to the original enhancer peptide is no greater than about 15 amino acid residues, more preferably no greater than about ten amino acid residues and most preferably no greater than about 5 amino acid residues.

Deletions are preferably deletions of no greater than about 3 amino acid residues in total (either consecutive or non-consecutive residues), more deletions preferably of 2 amino acids, most preferably deletions of single amino acids residues. Generally, deletions will be of amino acid residues corresponding to the "X" residues of the enhancer peptide consensus sequences.

Enhancer peptide sequences of the invention also comprise the particular enhancer peptide sequences depicted in FIGS. 2, 13 and Table 1 exhibiting one, two or three non-conservative amino acid substitutions, with two such substitutions being preferred and one such substitution being most preferred. "Non conservative" substitutions refer to substitutions with amino acid residues of dissimilar charge, size, and/or hydrophobicity/hydrophilicity characteristics from the amino acid residue being replaced. Such amino acid characteristics are well known to those of skill in the art.

In addition, the amino acid substitutions need not be, and in certain embodiments preferably are not, restricted to the genetically encoded amino acids. Indeed, the peptides may contain genetically non-encoded amino acids. Thus, in addition to the naturally occurring genetically encoded amino acids, amino acid residues in the peptides may be substituted with naturally occurring non-encoded amino acids and synthetic amino acids. Such substitutions can also be present within the core polypeptides of the hybrid polypeptides of the invention, whether or not they are present in the enhancer sequence/sequences of the particular hybrid polypeptide.

Certain commonly encountered amino acids which provide useful substitutions include, but are not limited to, β-alanine (β-Ala) and other omega-amino acids such as 3-aminopropionic acid, 2,3-diaminopropionic acid (Dpr), 4-aminobutyric acid and so forth; α-aminoisobutyric acid (Aib); ε-aminohexanoic acid (Aha); δ-aminovaleric acid (Ava); N-methylglycine or sarcosine (MeGly); ornithine (Orn); citrulline (Cit); t-butylalanine (t-BuA); t-butylglycine (t-BuG); N-methylisoleucine (MeIle); phenylglycine (Phg); cyclohexylalanine (Cha); norleucine (Nle); naphthylalanine (Nal); 4-chlorophenylalanine (Phe(4-Cl)); 2-fluorophenylalanine (Phe(2-F)); 3-fluorophenylalanine (Phe(3-F)); 4-fluorophenylalanine (Phe(4-F)); penicillamine (Pen); 1,2,3,4-tetrahydroisoquinoline-3-carboxylic acid (Tic); β-2-thienylalanine (Thi); methionine sulfoxide (MSO); homoarginine (hArg); N-acetyl lysine (AcLys); 2,4-diaminobutyric acid (Dbu); 2,3-diaminobutyric acid (Dab); p-aminophenylalanine (Phe(pNH$_2$)); N-methyl valine (MeVal); homocysteine (hCys), homophenylalanine (hphe) and homoserine (hSer); hydroxyproline (Hyp), homoproline (hPro), N-methylated amino acids, cyclic amino acid analogues (used, e.g., to constrain amino acid residues to particular conformational states, e.g., α α'- and .ββ'-substituted cyclic amino acids such as 1-aminocyclopentanecarboxylic acid (cycloleucine) and β,β-cyclopentamethylene-β-mercaptopropionic acid (see, e.g., Hruby et al., 1990, Biochem. J. 268:249–262). and peptoids or oligopeptoids (N-substituted amino acids, e.g., N-substituted glycines; see, e.g., Simon et al., 1972, Proc. Natl. Acad. Sci. USA 89:9367–9371).

While in most instances, the amino acids of the peptide will be substituted with L-enantiomeric amino acids, the substitutions are not limited to L-enantiomeric amino acids. Thus, also included in the definition of "mutated" or "altered" forms are those situations where an L-amino acid is replaced with an identical D-amino acid (e.g., L-Arg→D-Arg) or with a D-amino acid of the same category or subcategory (e,g., L-Arg→D-Lys), and vice versa. Such substitutions can also be present within the core polypeptides of the hybrid polypeptides of the invention, whether or not they are present in the enhancer sequence/sequences of the particular hybrid polypeptide.

In addition to the above-described amino acid substitutions, replacement of side chain moieties can be made by introducing, for example, a methyl group or pseudoisosteric groups with different electronic properties (see, e.g., Hruby et al., 1990, Biochem. J. 268:249–262). Further, double bonds can be introduced between adjacent carbon atoms of amino acids and cyclic peptides oranalogs can be formed by introducing covalent bonds such as forming an amide bond between N- and C-termini, between two side chains or between a side chain and the N- or C-terminus of the peptide. Such substitutions can also be present within the core polypeptides of the hybrid polypeptides of the invention, whether or not they are present in the enhancer sequence/sequences of the particular hybrid polypeptide.

The core and hybrid polypeptides of the invention can also be conjugated with one or more chemical groups. The chemical groups utilized for conjugation are preferably not significantly toxic or immunogenic, i.e., any toxicity or immunogenicity observed with a conjugate of a core or hybrid polypeptide is not significantly (i.e., less than 50%) greater than any toxicity or immunogenicity observed with the corresponding unmodified core or hybrid polypeptide.

Exemplary chemical groups include carbohydrates, such as, for example, those carbohydrates that occur naturally on glycoproteins, and non-proteinaceous polymers, such as polyols.

A polyol, for example, can be conjugated to core or hybrid polypeptide at one or more amino acid residues, including lysine residues. The polyol employed can be any water-soluble poly(alkylene oxide) polymer and can have a linear or branched chain. Suitable polyols include those substituted at one or more hydroxyl positions with a chemical group, such as an alkyl group having between one and four carbons. Typically, the polyol is a poly(alkylene glycol), such as poly(ethylene glycol) (PEG), and thus, for ease of description, the remainder of the discussion relates to an exemplary embodiment wherein the polyol employed is PEG and the process of conjugating the polyol to a core or hybrid polypeptide is termed "pegylation." However, those skilled in the art recognize that other polyols, such as, for example, poly(propylene glycol) and polyethylene-polypropylene glycol copolymers, can be employed using the techniques for conjugation described herein for PEG.

The average molecular weight of the PEG can range from about 500 to about 30,000 daltons (D); preferably, from about 1,000 to about 25,000 D; and more preferably, from about 4,000 to about 20,000 D. In one embodiment, pegylation is carried out with PEG having an average molecular weight of about 5,000 D (hereinafter "PEG(5000)"). In another embodiment, a branched-chain PEG having two chains of about 10,000 D each is employed.

PEG preparations that are commercially available, and suitable for use in the present invention, are nonhomogeneous preparations that are sold according to average molecular weight. For example, PEG(5000) preparations typically contain molecules that vary slightly in molecular weight, usually +/−500 D. A variety of methods for pegylating proteins have been described. See, e.g., U.S. Pat. No. 4,179,337, disclosing the conjugation of a number of hormones and enzymes to PEG and polypropylene glycol to produce physiologically active non-immunogenic compositions. Generally, a PEG having at least one terminal hydroxy group is reacted with a coupling agent to form an activated PEG having a terminal reactive group. Id. This reactive group can then react with the α- and ε-amines of proteins to form a covalent bond. Conveniently, the other end of the PEG molecule can be "blocked" with a non-reactive chemical group, such as a methoxy group, to reduce the formation of PEG-crosslinked complexes of protein molecules.

Suitable activated PEGs can be produced by a number of conventional reactions. For example, an N-hydroxysuccinimide ester of a PEG (M-NHS-PEG) can be prepared from PEG-monomethyl ether (which is commercially available from Union Carbide) by reaction with N,N'-dicyclohexylcarbodiimide (DCC) and N-hydroxysuccinimide (NHS), according to the method of Buckmann and Merr, Makromol. Chem., 182:1379–1384 (1981).

In addition, a PEG terminal hydroxy group can be converted to an amino group, for example, by reaction with thionyl bromide to form-PEG-Br, followed by aminolysis with excess ammonia to form PEG-NH$_2$. The PEG-NH$_2$ is then conjugated to the protein of interest using standard coupling reagents, such as Woodward's Reagent K. Furthermore, a PEG-terminal —CH$_2$ OH group can be converted to an aldehyde group, for example, by oxidation with MnO$_2$. The aldehyde group is conjugated to the protein by reductive alkylation with a reagent such as cyanoborohydride.

Alternatively, activated PEGs suitable for use in the present invention can be purchased from a number of vendors. For example, Shearwater Polymers, Inc. (Huntsville, Ala.) sells M-NHS-PEG as "SCM-PEG" in addition to a succinimidyl carbonate of methoxy-PEG ("SC-PEG") and methoxy-PEG succinimidyl propionate ("SPA-PEG").

The degree of pegylation of a variant of the present invention can be adjusted to provide a desirably increased in vivo half-life, compared to the corresponding non-pegylated protein. It is believed that the half-life of a pegylated core or hybrid polypeptide typically increases incrementally with increasing degree of pegylation.

It is to be understood that the present invention also contemplates peptide analogues wherein one or more amide linkage is optionally replaced with a linkage other than amide, preferably a substituted amide or an isostere of amide. See, e.g., Spatola (1983) in "Chemistry and Biochemistry of Amino Acids, Peptides and Proteins," Volume VII, (Weinstein, ed.), Marcel Dekker, N.Y., 267–357, which is incorporated herein by reference in its entirety.

Thus, while the amino acid residues within peptides are generally described in terms of amino acids, and preferred embodiments of the invention are exemplified by way of peptides, one having skill in the art will recognize that in embodiments having non-amide linkages, the term "amino acid" or "residue" as used herein refers to other bifunctional moieties bearing groups similar in structure to the side chains of the amino acids. Such modifications can also be present within the core polypeptides of the hybrid polypeptides of the invention, whether or not they are present in the enhancer sequence/sequences of the particular hybrid polypeptide.

In addition, one or more of the amino acid residues of the hybrid polypeptide may be blocked.

Additionally, one or more amide linkages of the hybrid polypeptide can be replaced with peptidomimetic or amide mimetic moieties which do not significantly interfere with the structure or activity of the peptides. Suitable amide mimetic moieties are described, for example, in Olson et al., 1993, J. Med. Chem. 36:3049.

Peptide mimetics of the polypeptides of the invention are also intended to fall within the scope of the present invention. Peptide mimetics are structures which serve as substitutes for peptides or portions of peptides (see Morgan et al., 1989, Ann. Reports Med. Chem. 24:243–252 for a review of peptide mimetics). Peptide mimetics, as used herein, include synthetic structures which may or may not contain amino acids and/or peptide bonds, but retain the structural and functional features of a core or hybrid polypeptide. For instance, non-hydrolyzable peptide analogs of amino acid residues can be generated using benzodiazepine (e.g., see Freidinger et al. in Peptides: Chemistry and Biology, G. R. Marshall ed., ESCOM Publisher: Leiden, Netherlands, 1988), azepine (e., see Huffman et al. in Peptides: Chemistry and Biology, G. R. Marshall ed., ESCOM Publisher: Leiden, Netherlands, 1988), substituted gamma lactamn rings (Garvey et al. in Peptides: Chemistry and Biology, G. R. Marshall, ed., ESCOM Publisher: Leiden, Netherlands, 1988), keto-methylene pseudopeptides (Ewenson et al. (1986) J. Med. Chem. 29:295; and Ewenson et al. in Peptides: Structure and Function (Proceedings of the 9th American Peptide Symposium) Pierce Chemical Co. Rockland, Ill., 1985), β-turn dipeptide cores (Nagai et al., 1985, Tetrahedron Lett 26:647; and Sato et al., 1986, J. Chem. Soc. Perkin Trans. 1:1231), and β-aminoalcohols (Gordon et al., 1985, Biochem. Biophys. Res. Commun. 126:419; and Dann et al., 1986, Biochem. Biophys. Res. Commun. 134:71).

Further included as part of the invention are peptide libraries, comprising collections of core and/or hybrid polypeptides, including phage display libraries expressing such core and/or hybrid polypeptides.

Enhancer peptide sequences can be used to enhance the pharmacokinetic properties of the core polypeptide as either N-terminal, C-terminal, or - and C-terminal additions. While it is preferable for the enhancer peptide sequences to be utilized in a pairwise fashion, that is, preferably hybrid polypeptides comprise an enhancer peptide sequence at both the amino- and carboxy-termini, hybrid polypeptides can also comprise a single enhancer peptide, said peptide present at either the amino- or carboxy-terminus of the hybrid polypeptide. Further, the enhancer peptides can be used in either forward or reverse orientation, or in any possible combination, linked to a core polypeptide. It is noted that any of the enhancer peptides can be introduced at either the N-terminus or the C-terminus of the core polypeptide. Still further, multiple enhancer peptide sequences can be introduced to the N-, C-, or N- and C-terminal positions of the hybrid polypeptides. Multiple enhancer peptide sequences can be linked directly one to another via the same sorts of linkages as used to link an enhancer peptide sequence to the core polypeptide (see below). In addition, an intervening amino acid sequence of the same sort as described below can also be present between one or more of the multiple enhancer peptide sequences. Multiple enhancer peptide sequences will typically contain from 2 to about 10 individual enhancer peptide sequences (of the same or different amino acid sequence), with about 2 to about 4 being preferred.

It is understood that the core polypeptide is generally linked to the enhancer peptides via a peptide amide linkage, although linkages other than amide linkages can be utilized to join the enhancer peptide sequences to the core polypeptides. Such linkages are well known to those of skill in the art and include, for example, any carbon-carbon, ester or chemical bond that functions to link the enhancer peptide sequences of the invention to a core peptide.

Typically, an enhancer peptide sequence is linked directly to a core polypeptide. An enhancer peptide sequence can also be attached to an intervening amino acid sequence present between the enhancer peptide sequence and the core polypeptide. The intervening amino acid sequence can typically range in size from about 1 to about 50 amino acid residues in length, with about 1 to about 10 residues in length being preferred. The same sorts of linkages described for linking the enhancer peptide to the core polypeptide can be used to link the enhancer peptide to the intervening peptide.

As discussed for enhancer peptide sequences, above, core and intervening amino acid sequences need not be restricted to the genetically encoded amino acids, but can comprise any of the amino acid and linkage modifications described above.

The amino- and/or carboxy-termini of the resulting hybrid polypeptide can comprise an amino group (—NH$_2$) or a carboxy (—COOH) group, respectively. Alternatively, the hybrid polypeptide amino-terminus may, for example, represent a protecting group, e.g., a hydrophobic group, including but not limited to carbobenzyl, dansyl, T-butoxycarbonyl (Boc), decanoyl or napthoyl; an acetyl group; 9-fluorenylmethoxycarbonyl (Fmoc) group; a macromolecular carrier group, including but not limited to lipid-fatty acid conjugates, polyethylene glycol, or carbohydrates; or a modified, non-naturally occurring amino acid residue. Alternatively, the hybrid polypeptide carboxy-terminus can, for example, represent an amido group; a protecting group, e.g., a T-butoxycarbonyl group (Boc); a macromolecular carrier group, including but not limited to lipid-fatty acid conjugates, polyethylene glycol, or carbohydrates; or a modified non-naturally occurring amino acid residue. As a non-limiting example, the amino- and/or carboxy-termini of the resulting hybrid polypeptide can comprise any of the amino- and/or carboxy-terminal modifications depicted in the peptides shown in FIG. 13 or Table 2, below.

Typically, a hybrid polypeptide comprises an amino acid sequence that is a non-naturally occurring amino acid sequence. That is, typically, the amino acid sequence of a hybrid polypeptide, does not consist solely of the amino acid sequence of a fragment of an endogenous, naturally occurring polypeptide. In addition, a hybrid polypeptide is not intended to consist solely of a full-length, naturally occurring polypeptide.

Core polypeptides can comprise any polypeptide which may be introduced into a living system, for example, any polypeptide that can function as a pharmacologically useful polypeptide. Such core polypeptides can, for example, be useful for the treatment or prevention of disease, or for use in diagnostic or prognostic methods, including in vivo imaging methods. The lower size limit of a core polypeptide is typically about 4–6 amino acid residues. There is, theoretically, no core polypeptide upper size limit and, as such a core polypeptide can comprise any naturally occurring polypeptide or fragment thereof, or any modified or synthetic polypeptide. Typically, however, a core polypeptide ranges from about 4–6 amino acids to about 494–500 amino acids, with about 4 to about 94–100 amino acid residues being preferred and about 4 to about 34–40 amino acid residues being most preferred.

Examples of possible core polypeptides, provided solely as example and not by way of limitation, include, but are not limited to, growth factors, cytokines, therapeutic polypeptides, hormones, e.g., insulin, and peptide fragments of hormones, inhibitors or enhancers of cytokines, peptide growth and differentiation factors, interleukins, chemokines, interferons, colony stimulating factors, angiogenic factors, receptor ligands, agonists, antagonists or inverse agonists, peptide targeting agents such as imaging agents or cytotoxic targeting agents, and extracellular matrix proteins such as collagen, laminin, fibronectin and integrin to name a few. In addition, possible core polypeptides may include viral or bacterial polypeptides that may function either directly or indirectly as immunogens or antigens, and thus may be useful in the treatment or prevention of pathological disease.

Representative examples of hybrid polypeptides which comprise core polypeptides derived from viral protein sequences are shown in FIG. 13, wherein the core polypeptide sequences are shaded. Core polypeptides also include, but are not limited to, the polypeptides disclosed in U.S. Pat. No. 5,464,933, U.S. Pat. No. 5,656,480 and WO 96/19495, each of which is incorporated herein by reference in its entirety.

Core polypeptide sequences can further include, but are not limited to the polypeptide sequences depicted in Table 2, and in the Example presented in Section 11, below. It is noted that the peptides listed in Table 2 include hybrid polypeptides in addition to core polypeptides. The sequence of the hybrid polypeptides will be apparent, however, in light of the terminal enhancer peptide sequences present as part of the hybrid polypeptides.

TABLE 2

| T No. | Sequence | Seq. ID No. |
|---|---|---|
| 1 | GIKQLQARILAVERYLKDQ | 1 |
| 2 | NNLLRAIEAQQHLLQLTVW | 2 |
| 3 | NEQELLELDKWASLWNWF | 3 |
| 4 | YTSLIHSLIEESQNQQEK | 4 |
| 5 | Ac-VWGIKQLQARILAVERYLKDQQLLGIWG-NH2 | 5 |

TABLE 2-continued

| T No. | Sequence | Seq. ID No. |
|---|---|---|
| 6 | QHLLQLTVWGIKQLQARILAVERYLKDQ | 6 |
| 7 | LRAIEAQQHLLQLTVWGIKQLQARILAV | 7 |
| 8 | VQQQNNLLARIEAQQHLLQLTVWGIKQL | 8 |
| 9 | RQLLSGIVQQQNNLLRAIEAQQHLLQLT | 9 |
| 10 | MTLTVQARQLLSGIVQQQNNLLRAIEAQ | 10 |
| 12 | VVSLSNGVSVLTSKVLDLKNYIDKQLL | 11 |
| 13 | LLSTNKAVVSLSNGVSVLTSKVLDLKNY | 12 |
| 15 | Ac-VLHLEGEVNKIKSALLSTNKAVVSLSNG-NH2 | 13 |
| 19 | Ac-LLSTNKAVVSLSNGVSVLTSKVLDLKNY-NH2 | 14 |
| 20 | Ac-YTSLIHSLIEESQNQQEKNEQELLELDKWASLWNWF-NH2 | 15 |
| 21 | Ac-NNLLRAIEAQQHLLQLTVWGIKQLQARILAVERYLKDQ-NH2 | 16 |
| 22 | Ac-IELSNIKENKCNGTDAKVKLIKQELDKYKNAVTELQLLMQST-NH2 | 17 |
| 23 | Ac-IELSNIKENKCNGTDAKVKLIKQELDKY-NH2 | 18 |
| 24 | Ac-ENKCNGTDAKVKLIKQELDKYKNAVTEL-NH2 | 19 |
| 25 | Ac-DAKVKLIKQELDKYKNAVTELQLLMQST-NH2 | 20 |
| 26 | Ac-CNGTDAKVKLIKQELDKYKNAVTELQLL-NH2 | 21 |
| 27 | Ac-SNIKENKCNGTDAKVKLIKQELDKYKNAVTELQLL-NH2 | 22 |
| 28 | Ac-ASGVAVSKVLHLEGEVNKIKSALLSTNKAVVSLSNGV-NH2 | 23 |
| 29 | Ac-SGVAVSKVLHLEGEVNKIKSALLSTNKAVVSLSNG-NH2 | 24 |
| 30 | Ac-VLHLEGEVNKIKSALLSTHKAVVSLSNGVSVLTSK-NH2 | 25 |
| 31 | Ac-ARKLQRMKQLEDKVEELLSKNYHYLENEVARLKKLV-NH2 | 26 |
| 32 | Ac-RMKQLEDKVEELLSKNYHYLENEVARLKKLVGER-NH2 | 27 |
| 33 | Ac-VQQQNNLLRAIEAQQHLLQLTVWGIKQL-NH2 | 28 |
| 34 | Ac-LRAIEAQQHLLQLTVWGIKQLQARILAV-NH2 | 29 |
| 35 | Ac-QHLLQLTVWGIKQLQARILAVERYLKDQ-NH2 | 30 |
| 36 | Ac-RQLLSGIVQQQNNLLRAIEAQQHLLQLT-NH2 | 31 |
| 37 | Ac-MTLTVQARQLLSGIVQQQNNLLRAIEAQ-NH2 | 32 |
| 38 | Ac-AKQARSDIEKLKEAIRDTNKAVQSVQSS-NH2 | 33 |
| 39 | Ac-AAVALVEAKQARSDIEKLKEAIRDTNKAVQSVQSS-NH2 | 34 |
| 40 | Ac-AKQARSDIEKLKEAIRDTNKAVQSVQSSIGNLIVA-NH2 | 35 |
| 41 | Ac-GTIALGVATSAQITAAVALVEAKQARSD-NH2 | 36 |
| 42 | Ac-ATSAQITAAVALVEAKQARSDIEKLKEA-NH2 | 37 |
| 43 | Ac-AAVALVEAKQARSDIEKLKEAIRDTNKA-NH2 | 38 |
| 44 | Ac-IEKLKEAIRDTNKAVQSVQSSIGNLIVA-NH2 | 40 |
| 45 | Ac-IRDTNKAVQSVQSSIGNLIVAIKSVQDY-NH2 | 41 |
| 46 | Ac-AVQSVQSSIGNLIVAIKSVQDYVNKEIV-NH2 | 42 |
| 47 | Ac-QARQLLSGIVQQQNNLLRAIEAQQHLLQLTVWGIKQLARILAVERYLKDQ-NH2 | 43 |
| 48 | Ac-QARQLLSGIVQQQNNLLRAIEAQQHLLQ-NH2 | 44 |
| 49 | Ac-MTWMEMDREINNYTSLIGSLIEESQNQQEKNEQELLELDKWASLWNWF-NH2 | 45 |
| 50 | Ac-WMEWDREINNYTSLIGSLIEESQNQQEKNEQELLE-NH2 | 46 |
| 51 | Ac-INNYTSLIGSLIEESQNQQEKNEQELLE-NH2 | 47 |
| 52 | Ac-INNYTSLIGSLIEESQNQQEKNEQELLELDKWASL-NH2 | 48 |
| 53 | Ac-EWDREINNYTSLIGSLIEESQNQQEKNEQEGGC-NH2 | 49 |
| 54 | Ac-QSRTLLAGIVQQQQQLLDVVKRQQELLR-NH2 | 50 |
| 55 | Ac-NNDTWQEWERKVDFLEENITALLEEAQIQQEKNMYELQKLNSWD-NH2 | 51 |
| 56 | Ac-WQEWERKVDFLEENITALLEEAQIQQEK-NH2 | 52 |
| 57 | Ac-VDFLEENITALLEEAQIQQEKNMYELQK-NH2 | 53 |
| 58 | Ac-ITALLEEAQIQQEKNMYELQKLNSWDVF-NH2 | 54 |
| 59 | Ac-SSESFTLLEQWNNWKLQLAEQWLEQINEKHYLEDIS-NH2 | 55 |
| 60 | Ac-DKWASLWNWF-NH2 | 56 |
| 61 | Ac-NEQELLELDKWASLWNWF-NH2 | 57 |
| 62 | Ac-EKNEQELLELDKWASLWNWF-NH2 | 58 |
| 63 | Ac-NQQEKNEQELLELDKWASLWNWF-NH2 | 59 |
| 64 | Ac-ESQNQQEKNEQELLELDKWASLWNWF-NH2 | 60 |
| 65 | Ac-LIHSLIEESQNQQEKNEQELLELDKWASLWNWF-NH2 | 61 |
| 66 | Ac-NDQKKLMSNNVQIVRQQSYSIMSIIKEE-NH2 | 62 |
| 67 | Ac-DEFDASISQVNEKINQSLAFIRKSDELL-NH2 | 63 |
| 68 | Ac-VSKGYSALRTGWYTSVITIELSNIKEN-NH2 | 64 |
| 69 | Ac-VVSLSNGVSVLTSKVLDLKNYIDKQLL-NH2 | 65 |
| 70 | Ac-VNKIKSALLSTNKAVVSLSNGVSVLTSK-NH2 | 66 |
| 71 | Ac-PIINFYDPLVFPSDEFDASISQVNEKINQSLAFIR-NH2 | 67 |
| 72 | Ac-NLVYAQLQFTYDTLRGYINRALAQIAEA-NH2 | 68 |
| 73 | Ac-LNQVDLTETLERYQQRLNTYALVSKDASYRS-NH2 | 69 |
| 74 | Ac-ELLVLKKAQLNRHSYLKDSDFLDAALD-NH2 | 70 |
| 75 | Ac-LAEAGEESVTEDTEREDTEEEREDEEE-NH2 | 71 |
| 76 | Ac-ALLAEAGEESVTEDTEREDTEEEREDEEEENEART-NH2 | 72 |
| 77 | Ac-ETERSVDLVAALLAEAGEESVTEDTEREDTEEERE-NH2 | 73 |
| 78 | Ac-EESVTEDTEREDTEEEREDEEEENEART-NH2 | 74 |
| 79 | Ac-VDLVAALLAEAGEESVTEDTEREDTEEE-NH2 | 75 |
| 80 | Ac-NSETERSVDLVAALLAEAGEESVTE-NH2 | 76 |
| 81 | Ac-DISYAQLQFTYDVLKDYINDALRNIMDA-NH2 | 77 |
| 82 | Ac-SNVFSKDEIMREYNSQKQHIRTLSAKVNDN-NH2 | 78 |
| 83 | Biotin-YTSLIHSLIEESQNQQEKNEQELLELDKWASLWNWF-NH2 | 1076 |
| 84 | Dig-YTSLIHSLIEESQNQQEKNEQELLELDKWASLWNWF-NH2 | 1076 |
| 85 | Biotin-NNLLRAIEAQQHLLQLTVWGIKQLQARILAVERYLKDQ-NH2 | 16 |
| 86 | Dig-NNLLRAIEAQQHLLQLTVWGIKQLQARILAVERYLKDQ-NH2 | 16 |

TABLE 2-continued

| T No. | Sequence | Seq. ID No. |
|---|---|---|
| 87 | Ac-VLHQLNIQLKQYLETQERLLAGNRIAARQLLQIWKDVA-NH2 | 83 |
| 88 | Ac-LWHEQLLNTAQRAGLQLQLINQALAVREKVLIRYDIQK-NH2 | 84 |
| 89 | Ac-LLDNFESTWEQSKELWEQQEISIQNLHKSALQEYW-NH2 | 85 |
| 90 | Ac-LSNLLQISNNSDEWLEALEIEHEKWKLTQWQSYEQF-NH2 | 86 |
| 91 | Ac-KLEALEGKLEALEGKLEALEGKLEALEGKLEALEGK-NH2 | 87 |
| 92 | Ac-ELRALRGELRALRGELRALRGELRALRGELRALRGK-NH2 | 88 |
| 93 | Ac-ELKAKELEGEGLAEGEEALKGLLEKAAKLEGLELLK-NH2 | 89 |
| 94 | Ac-WEAAAREAAAREAAAREAAARA-NH2 | 90 |
| 95 | Ac-YTSLIHSLIEESQNQQEKNEQELLELDKWASLWNAF-NH2 | 91 |
| 96 | Ac-YTSLIHSLIEESQNQQEKNEQELLELDKWASLANWF-NH2 | 92 |
| 97 | Ac-YTSLIHSLIEESQNQQEKNQQELLELDKWASLWNWF-NH2 | 93 |
| 98 | Ac-YTSLIHSLIEESQNQQEKNEQELLQLDKWASLWNWF-NH2 | 94 |
| 99 | Ac-YTSLIHSLIEESQNQQEKNQQELLQLDKWASLWNWF-NH2 | 95 |
| 100 | Ac-RMKQLEDKVEELLSKNYHLENEVARLKKLVGER-NH2 | 96 |
| 101 | Ac-QQLLQLTVWGIKQLQARILAVERYLKNQ-NH2 | 97 |
| 102 | Ac-NEQELLELDKWASLWNWF-NH2 | 98 |
| 103 | Ac-YTSLIQSLIEESQNQQEKNEQELLELDKWASLWNWF-NH2 | 99 |
| 104 | Ac-IINFYDPLVFPSDEFDASISQVNEKINQSLAFIRK-NH2 | 100 |
| 105 | Ac-INFYDPLVFPSDEFDASISQVNEKINQSLAFIRKS-NH2 | 101 |
| 106 | Ac-NFYDPLVFPSDEFDASISQVNEKIINQSLAFIRKSD-NH2 | 102 |
| 107 | Ac-FYDPLVFPSDEFDASISQVNEKINQSLAFIRKSDE-NH2 | 103 |
| 108 | Ac-YDPLVFPSDEFDASISQVNEKINQSLAFIRKSDEL-NH2 | 104 |
| 109 | Ac-DPLVFPSDEFDASISQVNEKINQSLAFIRKSDELL-NH2 | 105 |
| 110 | Ac-PLVFPSDEFDASISQVNEKINQSLAFIRKSDELLH-NH2 | 106 |
| 111 | Ac-LVFPSDEFDASISQVNEKINQSLAFIRKSDELLHN-NH2 | 107 |
| 112 | Ac-VFPSDEFDASISQVNEKINQSLAFIRKSDELLHNV-NH2 | 108 |
| 113 | Ac-FPSDEFDASISQVNEKINQSLAFIRKSDELLHNVN-NH2 | 109 |
| 114 | Ac-PSDEFDASISQVNEKINQSLAFIRKSDELLHNVNA-NH2 | 110 |
| 115 | Ac-SDEFDASISQVNEKINQSLAFIRKSDELLHNVNAG-NH2 | 111 |
| 116 | Ac-DEFDASISQVNEKINQSLAFIRKSDELLHNVNAGK-NH2 | 112 |
| 117 | Ac-EFDASISQVNEKINQSLAFIRKSDELLHNVNAGKS-NH2 | 113 |
| 118 | Ac-FDASISQVNEKINQSLAFIRKSDELLHNVNAGKST-NH2 | 114 |
| 119 | Ac-DASISQVNEKINQSLAFIRKSDELLHNVNAGKSTT-NH2 | 115 |
| 120 | Ac-ASGVAVSKVLHLEGEVNKIKSALLSTNKAVVSLSN-NH2 | 116 |
| 121 | Ac-SGVAVSKVLHLEGEVNKIKSALLSTNKAVVSLSNG-NH2 | 117 |
| 122 | Ac-GVAVSKVLHLEGEVNKIKSALLSTNKAVVSLSNGV-NH2 | 118 |
| 123 | Ac-VAVSKVLHLEGEVNKIKSALLSTNKAVVSLSNGVS-NH2 | 119 |
| 124 | Ac-AVSKVLHLEGEVNKIKSALLSTNKAVVSLSNGVSV-NH2 | 120 |
| 125 | Ac-VSKVLHLEGEVNKIKSALLSTNKAVVSLSNGVSVL-NH2 | 121 |
| 126 | Ac-SKVLHLEGEVNKIKSALLSTNKAVVSLSNGVSVLT-NH2 | 122 |
| 127 | Ac-KVLHLEGEVNKIKSALLSTNKAVVSLSNGVSVLTS-NH2 | 123 |
| 128 | Ac-VLHLEGEVNKIKSALLSTNKAVVSLSNGVSVLTSK-NH2 | 124 |
| 129 | Ac-LHLEGEVNKIKSALLSTNKAVVSLSNGVSVLTSKV-NH2 | 125 |
| 130 | Ac-HLEGEVNKIKSALLSTNKAVVSLSNGVSVLTSKVL-NH2 | 126 |
| 131 | Ac-LEGEVNKIKSALLSTNKAVVSLSNGVSVLTSKVLD-NH2 | 127 |
| 132 | Ac-EGEVNKIKSALLSTNKAVVSLSNGVSVLTSKVLDL-NH2 | 128 |
| 133 | Ac-GEVNKIKSALLSTNKAVVSLSNGVSVLTSKVLDLK-NH2 | 129 |
| 134 | Ac-EVNKIKSALLSTNKAVVSLSNGVSVLTSKVLDLKN-NH2 | 130 |
| 135 | Ac-VNKIKSALLSTNKAVVSLSNGVSVLTSKVLDLKNY-NH2 | 131 |
| 136 | Ac-NKIKSALLSTNKAVVSLSNGVSVLTSKVLDLKNYI-NH2 | 132 |
| 137 | Ac-KIKSALLSTNKAVVSLSNGVSVLTSKVLDLKNYID-NH2 | 133 |
| 138 | Ac-IKSALLSTNKAVVSLSNGVSVLTSKVLDLKNYIDK-NH2 | 134 |
| 139 | Ac-KSALLSTNKAVVSLSNGVSVLTSKVLDLKNYIDKQ-NH2 | 135 |
| 140 | Ac-SALLSTNKAVVSLSNGVSVLTSKVLDLKNYIDKQL-NH2 | 136 |
| 141 | Ac-ALLSTNKAVVSLSNGVSVLTSKVLDLKNYIDKQLL-NH2 | 137 |
| 142 | Ac-YTSVITIELSNIKENKCNGTDAKVKLIKQELDKYK-NH2 | 138 |
| 143 | Ac-TSVITIELSNIKENKCNGTDAKVKLIKQELDKYKN-NH2 | 139 |
| 144 | Ac-SVITIELSNIKENKCNGTDAKVKLIKQELDKYKNA-NH2 | 140 |
| 145 | Ac-VITIELSNIKENKCNGTDAKVKLIKQELDKYKNAV-NH2 | 141 |
| 146 | Ac-ITIELSNIKENKCNGTDAKVKLIKQELDKYKNAVT-NH2 | 142 |
| 147 | Ac-TIELSNIKENKCNGTDAKVKLIKQELDKYKNAVTE-NH2 | 143 |
| 148 | Ac-IELSNIKENKCNGTDAKVKLIKQELDKYKNAVTEL-NH2 | 144 |
| 149 | Ac-ELSNIKENKCNGTDAKVKLIKQELDKYKNAVTELQ-NH2 | 145 |
| 150 | Ac-LSNIKENKCNGTDAKVKLIKQELDKYKNAVTELQL-NH2 | 146 |
| 151 | Ac-SNIKENKCNGTDAKVKLIKQELDKYKNAVTELQLL-NH2 | 147 |
| 152 | Ac-NIKENKCNGTDAKVKLIKQELDKYKNAVTELQLLM-NH2 | 148 |
| 153 | Ac-IKENKCNGTDAKVKLIKQELDKYKNAVTELQLLMQ-NH2 | 149 |
| 154 | Ac-KENKCNGTDAKVKLIKQELDKYKNAVTELQLLMQS-NH2 | 150 |
| 155 | Ac-ENKCNGTDAKVKLIKQELDKYKNAVTELQLLMQST-NH2 | 151 |
| 156 | Ac-LLDNFESTWEQSKELWELQEISIQNLHKSALQEYWN-NH2 | 152 |
| 157 | Ac-ALGVATSAQITAAVALVEAKQARSDIEKLKEAIRD-NH2 | 153 |
| 158 | Ac-LGVATSAQITAAVALVEAKQARSDIEKLKEAIRDT-NH2 | 154 |
| 159 | Ac-GVATSAQITAAVALVEAKQARSDIEKLKEAIRDTN-NH2 | 155 |
| 160 | Ac-VATSAQITAAVALVEAKQARSDIEKLKEAIRDTNK-NH2 | 156 |
| 161 | Ac-ATSAQITAAVALVEAKQARSDIEKLKEAIRDTNKA-NH2 | 157 |
| 162 | Ac-TSAQITAAVALVEAKQARSDIEKLKEAIRDTNKAV-NH2 | 158 |

TABLE 2-continued

| T No. | Sequence | Seq. ID No. |
|---|---|---|
| 163 | Ac-SAQITAAVALVEAKQARSDIEKLKEAIRDTNKAVQ-NH2 | 159 |
| 164 | Ac-AQITAAVALVEAKQARSDIEKLKEAIRDTNKAVQS-NH2 | 160 |
| 165 | Ac-QITAAVALVEAKQARSDIEKLKEAIRDTNKAVQSV-NH2 | 161 |
| 166 | Ac-ITAAVALVEAKQARSDIEKLKEAIRDTNKAVQSVQ-NH2 | 162 |
| 167 | Ac-TAAVALVEAKQARSDIEKLKEAIRDTNKAVQSVQS-NH2 | 163 |
| 168 | Ac-AAVALVEAKQARSDIEKLKEAIRDTNKAVQSVQSS-NH2 | 164 |
| 169 | Ac-AVALVEAKQARSDIEKLKEAIRDTNKAVQSVQSSI-NH2 | 165 |
| 170 | Ac-VALVEAKQARSDIEKLKEAIRDTNKAVQSVQSSIG-NH2 | 166 |
| 171 | Ac-ALVEAKQARSDIEKLKEAIRDTNKAVQSVQSSIGN-NH2 | 167 |
| 172 | Ac-LVEAKQARSDIEKLKEAIRDTNKAVQSVQSSIGNL-NH2 | 168 |
| 173 | Ac-VEAKQARSDIEKLKEAIRDTNKAVQSVQSSIGNLI-NH2 | 169 |
| 174 | Ac-EAKQARSDIEKLKEAIRDTNKAVQSVQSSIGNLIV-NH2 | 170 |
| 175 | Ac-KQARSDIEKLKEAIRDTNKAVQSVQSSIGNLIVAI-NH2 | 171 |
| 176 | Ac-QARSDIEKLKEAIRDTNKAVQSVQSSIGNLIVAIK-NH2 | 173 |
| 177 | Ac-ARSDIEKLKEAIRDTNKAVQSVQSSIGNLIVAIKS-NH2 | 174 |
| 178 | Ac-RSDIEKLKEAIRDTNKAVQSVQSSIGNLIVAIKSV-NH2 | 175 |
| 179 | Ac-SDIEKLKEAIRDTNKAVQSVQSSIGNLIVAIKSVQ-NH2 | 176 |
| 180 | Ac-DIEKLKEAIRDTNKAVQSVQSSIGNLIVAIKSVQD-NH2 | 177 |
| 181 | Ac-IEKLKEAIRDTNKAVQSVQSSIGNLIVAIKSVQDY-NH2 | 178 |
| 182 | Ac-EKLKEAIRDTNKAVQSVQSSIGNLIVAIKSVQDYV-NH2 | 179 |
| 183 | Ac-KLKEAIRDTNKAVQSVQSSIGNLIVAIKSVQDYVN-NH2 | 180 |
| 184 | Ac-LKEAIRDTNKAVQSVQSSIGNLIVAIKSVQDYVNK-NH2 | 181 |
| 185 | Ac-KEAIRDTNKAVQSVQSSIGNLIVAIKSVQDYVNKE-NH2 | 182 |
| 186 | Ac-EAIRDTNKAVQSVQSSIGNLIVAIKSVQDYVNKEI-NH2 | 183 |
| 187 | Ac-AIRDTNKAVQSVQSSIGNLIVAIKSVQDYVNKEIV-NH2 | 184 |
| 188 | Ac-IRDTNKAVQSVQSSIGNLIVAIKSVQDYVNKEIV-NH2 | 185 |
| 189 | Ac-YTPNDITLNNSVALDPIDISIELNKAKSDLEESKE-NH2 | 186 |
| 190 | Ac-TPNDITLNNSVALDPIDISIELNKAKSDLEESKEW-NH2 | 187 |
| 191 | Ac-PNDITLNNSVALDPIDISIELNKAKSDLEESKEWI-NH2 | 188 |
| 192 | Ac-NDITLNNSVALDPIDISIELNKAKSDLEESKEWIR-NH2 | 189 |
| 193 | Ac-DITLNNSVALDPIDISIELNKAKSDLEESKEWIRR-NH2 | 190 |
| 194 | Ac-ITLNNSVALDPIDISIELNKAKSDLEESKEWIRRS-NH2 | 191 |
| 195 | Ac-TLNNSVALDPIDISIELNKAKSDLEESKEWIRRSN-NH2 | 192 |
| 196 | Ac-LNNSVALDPIDISIELNKAKSDLEESKEWIRRSNQ-NH2 | 193 |
| 197 | Ac-NNSVALDPIDISIELNKAKSDLEESKEWIRRSNQK-NH2 | 194 |
| 198 | Ac-NSVALDPIDISIELNKAKSDLEESKEWIRRSNQKL-NH2 | 195 |
| 200 | Ac-SVALDPIDISIELNKAKSDLEESKEWIRRSNQKLD-NH2 | 196 |
| 201 | Ac-VALDPIDISIELNKAKSDLEESKEWIRRSNQKLDS-NH2 | 197 |
| 202 | Ac-ALDPIDISIELNKAKSDLEESKEWIRRSNQKLDSI-NH2 | 198 |
| 203 | Ac-LDPIDISIELNKAKSDLEESKEWIRRSNQKLDSIG-NH2 | 199 |
| 204 | Ac-DPIDISIELNKAKSDLEESKEWIRRSNQKLDSIGN-NH2 | 200 |
| 205 | Ac-PIDISIELNKAKSDLEESKEWIRRSNQKLDSIGNW-NH2 | 201 |
| 206 | Ac-IDISIELNKAKSDLEESKEWIRRSNQKLDSIGNWH-NH2 | 202 |
| 207 | Ac-DISIELNKAKSDLEESKEWIRRSNQKLDSIGNWHQ-NH2 | 203 |
| 208 | Ac-ISIELNKAKSDLEESKEWIRRSNQKLDSIGNWHQS-NH2 | 204 |
| 209 | Ac-SIELNKAKSDLEESKEWIRRSNQKLDSIGNWHQSS-NH2 | 205 |
| 210 | Ac-IELNKAKSDLEESKEWIRRSNQKLDSIGNWHQSST-NH2 | 206 |
| 211 | Ac-ELNKAKSDLEESKEWIRRSNQKLDSIGNWHQSSTT-NH2 | 207 |
| 212 | Ac-ELRALRGELRALRGELRALRGELRALRGELRALRGK-NH2 | 208 |
| 213 | Ac-YTSLIHSLIEESQNQQQKNEQELLELDKWASLWNWF-NH2 | 209 |
| 214 | Ac-YTSLIHSLIEESQNQQEKNEQELLELNKWASLWNWF-NH2 | 210 |
| 215 | Ac-YTSLIHSLIEQSQNQQEKNEQELLELDKWASLWNWF-NH2 | 211 |
| 216 | Ac-YTSLIHSLIQESQNQQEKNEQELLELDKWASLWNWF-NH2 | 212 |
| 217 | Ac-YTSLIHSLIQQSQNQQQKNQQQLQLNKWASLWNWF-NH2 | 213 |
| 218 | Ac-EQELLELDKWASLWNWF-NH2 | 214 |
| 219 | Ac-QELLELDKWASLWNWF-NH2 | 215 |
| 220 | Ac-ELLELDKWASLWNWF-NH2 | 216 |
| 221 | Ac-LELDKWASLWNWF-NH2 | 218 |
| 222 | Ac-ELDKWASLWNWF-NH2 | 219 |
| 226 | Ac-WASLWNWF-NH2 | 223 |
| 227 | Ac-ASLWNWF-NH2 | 224 |
| 229 | Ac-YTSLIHSLIEESQNQQEKNEQELLELDKWASLANAA-NH2 | 226 |
| 230 | Ac-YTSLIHSLIEESQNQQEKNEQQLLELDKWASLWNWF-NH2 | 227 |
| 231 | Ac-YTSLIQSLIEESQNQQEKNQQELLELDKWASLWNWF-NH2 | 228 |
| 234 | Ac-EAAAREAAAREAAARLELDKWASLWNWF-NH2 | 231 |
| 236 | Ac-PSLRDPISAEISIQALSYALGGDINKVLEKLGYSG-NH2 | 233 |
| 237 | Ac-SLRDPISAEISIQALSYALGGDINKVLEKLGYSGG-NH2 | 234 |
| 238 | Ac-LRDPISAEISIQALSYALGGDINKVLEKLGYSGGD-NH2 | 235 |
| 239 | Ac-RDPISAEISIQALSYALGGDINKVLEKLGYSGGDL-NH2 | 236 |
| 240 | Ac-DPISAEISIQALSYALGGDINKVLEKLGYSGGDLL-NH2 | 237 |
| 241 | Ac-PISAEISIQALSYALGGDINKVLEKLGYSGGDLLG-NH2 | 238 |
| 242 | Ac-ISAEISIQALSYALGGDINKVLEKLGYSGGDLLGI-NH2 | 239 |
| 243 | Ac-SAEISIQALSYALGGDINKVLEKLGYSGGDLLGIL-NH2 | 240 |
| 244 | Ac-AEISIQALSYALGGDINKVLEKLGYSGGDLLGILE-NH2 | 241 |
| 245 | Ac-EISIQALSYALGGDINKVLEKLGYSGGDLLGILES-NH2 | 242 |
| 246 | Ac-ISIQALSYALGGDINKVLEKLGYSGGDLLGILESR-NH2 | 243 |

TABLE 2-continued

| T No. | Sequence | Seq. ID No. |
|---|---|---|
| 247 | Ac-SIQALSYALGGDINKVLEKLGYSGGDLLGILESRG-NH2 | 244 |
| 248 | Ac-IQALSYALGGDINKVLEKLGYSGGDLLGILESRGI-NH2 | 245 |
| 249 | Ac-QALSYALGGDINKVLEKLGYSGGDLLGILESRGIK-NH2 | 246 |
| 250 | Ac-ALSYALGGDINKVLEKLGYSGGDLLGILESRGIKA-NH2 | 247 |
| 251 | Ac-LSYALGGDINKVLEKLGYSGGDLLGILESRGIKAR-NH2 | 248 |
| 252 | Ac-PDAVYLHRIDLGPPISLERLDVGTNLGNAIAKLED-NH2 | 249 |
| 253 | Ac-DAVYLHRIDLGPPISLERLDVGTNLGNAIAKLEDA-NH2 | 250 |
| 254 | Ac-AVYLHRIDLGPPISLERLDVGTNLGNAIAKLEDAK-NH2 | 251 |
| 255 | Ac-VYLHRIDLGPPISLERLDVGTNLGNAIAKLEDAKE-NH2 | 252 |
| 256 | Ac-YLHRIDLGPPISLERLDVGTNLGNAIAKLEDAKEL-NH2 | 253 |
| 257 | Ac-LHRIDLGPPISLERLDVGTNLGNAIAKLEDAKELL-NH2 | 254 |
| 258 | Ac-HRIDLGPPISLERLDVGTNLGNAIAKLEDAKELLE-NH2 | 255 |
| 259 | Ac-RIDLGPPISLERLDVGTNLGNAIAKLEDAKELLES-NH2 | 256 |
| 260 | Ac-IDLGPPISLERLDVGTNLGNAIAKLEDAKELLESS-NH2 | 257 |
| 261 | Ac-DLGPPISLERLDVGTNLGNAIAKLEDAKELLESSD-NH2 | 258 |
| 262 | Ac-LGPPISLERLDVGTNLGNAIAKLEDAKELLESSDQ-NH2 | 259 |
| 263 | Ac-GPPISLERLDVGTNLGNAIAKLEDAKELLESSDQI-NH2 | 260 |
| 264 | Ac-PPISLERLDVGTNLGNAIAKLEDAKELLESSDQIL-NH2 | 261 |
| 265 | Ac-PISLERLDVGTNLGNAIAKLEDAKELLESSDQILR-NH2 | 262 |
| 266 | Ac-ISLERLDVGTNLGNAIAKLEDAKELLESSDQIRS-NH2 | 263 |
| 267 | Ac-SLERLDVGTNLGNAIAKLEDAKELLESSDQILRSM-NH2 | 264 |
| 268 | Ac-LERLDVGTNLGNAIAKLEDAKELLESSDQILRSMK-NH2 | 265 |
| 269 | Ac-EWIRRSNQKLDSI-NH2 | 266 |
| 270 | Ac-LELDKWASLANAF-NH2 | 267 |
| 271 | Ac-LELDKWASLFNFF-NH2 | 268 |
| 272 | Ac-LELDKWASLANWF-NH2 | 269 |
| 273 | Ac-LELDKWASLWNAF-NH2 | 270 |
| 274 | Ac-ELGNVNNSISNALDKLEESNSKLDKVNVKLTSTSA-NH2 | 271 |
| 275 | Ac-TELGNVNNSISNALDKLEESNSKLDKVNVKLTSTS-NH2 | 282 |
| 276 | Ac-STELGNVNNSISNALDKLEESNSKLDKVNVKLTST-NH2 | 273 |
| 277 | Ac-ISTELGNVNNSISNALDKLEESNSKLDKVNVKLTS-NH2 | 274 |
| 278 | Ac-DISTELGNVNNSISNALDKLEESNSKLDKVNVKLT-NH2 | 275 |
| 279 | Ac-LDISTELGNVNNSISNALDKLEESNSKLDKVNVKL-NH2 | 276 |
| 280 | Ac-NLDISTELGNVNNSISNALDKLEESNSKLDKVNVK-NH2 | 277 |
| 281 | Ac-GNLDISTELGNVNNSISNALDKLEESNSKLDKVNV-NH2 | 278 |
| 282 | Ac-TGNLDISTELGNVNNSISNALDKLEESNSKLDKVN-NH2 | 279 |
| 283 | Ac-VTGNLDISTELGNVNNSISNALDKLEESNSKLDKV-NH2 | 280 |
| 284 | Ac-IVTGNLDISTELGNVNNSISNALDKLEESNSKLDK-NH2 | 281 |
| 285 | Ac-VIVTGNLDISTELGNVNNSISNALDKLEESNSKLD-NH2 | 282 |
| 286 | Ac-QVIVTGNLDISTELGNVNNSISNALDKLEESNSKL-NH2 | 283 |
| 287 | Ac-SQVIVTGNLDISTELGNVNNSISNALDKLEESNSK-NH2 | 284 |
| 288 | Ac-DSQVIVTGNLDISTELGNVNNSISNALDKLEESNS-NH2 | 285 |
| 289 | Ac-LDSQVIVTGNLDISTELGNVNNSISNALDKLEESN-NH2 | 286 |
| 290 | Ac-ILDSQVIVTGNLDISTELGNVNNSISNALDKLEES-NH2 | 287 |
| 291 | Ac-SILDSQVIVTGNLDISTELGNVNNSISNALDKLEE-NH2 | 288 |
| 292 | Ac-ISILDSQVIVTGNLDISTELGNVNNSISNALDKLE-NH2 | 289 |
| 293 | Ac-NISILDSQVIVTGNLDISTELGNVNNSISNALDKL-NH2 | 290 |
| 294 | Ac-KNISILDSQVIVTGNLDISTELGNVNNSISNALDK-NH2 | 291 |
| 295 | Ac-QKNISILDSQVIVTGNLDISTELGNVNNSISNALD-NH2 | 292 |
| 296 | Ac-YQKNISILDSQVIVTGNLDISTELGNVNNSISNAL-NH2 | 293 |
| 297 | Ac-TYQKNISILDSQVIVTGNLDISTELGNVNNSISNA-NH2 | 294 |
| 298 | Ac-ATYQKNISILDSQVIVTGNLDISTELGNVNNSISN-NH2 | 295 |
| 299 | Ac-DATYQKNISILDSQVIVTGNLDISTELGNVNNSIS-NH2 | 296 |
| 300 | Ac-FDATYQKNISILDSQVIVTGNLDISTELGNVNNSI-NH2 | 297 |
| 301 | Ac-EFDATYQKNISILDSQVIVTGNLDISTELGNVNNS-NH2 | 298 |
| 302 | Ac-GEFDATYQKNISILDSQVIVTGNLDISTELGNVNN-NH2 | 299 |
| 303 | Ac-SGEFDATYQKNISILDSQVIVTGNLDISTELGNVN-NH2 | 300 |
| 304 | Ac-LSGEFDATYQKNISILDSQVIVTGNLDISTELGNV-NH2 | 301 |
| 305 | Ac-RLSGEFDATYQKNISILDSQVIVTGNLDISTELGN-NH2 | 302 |
| 306 | Ac-LRLSGEFDATYQKNISILDSQVIVTGNLDISTELG-NH2 | 303 |
| 307 | Ac-TLRLSGEFDATYQKNISILDSQVIVTGNLDISTEL-NH2 | 304 |
| 308 | Ac-ITLRLSGEFDATYQKNISILDSQVIVTGNLDISTE-NH2 | 305 |
| 309 | Ac-GITLRLSGEFDATYQKNISILDSQVIVTGNLDIST-NH2 | 306 |
| 310 | Ac-TATIEAVHEVTDGLSQLAVAVGKMQQFVNDQFNNT-NH2 | 307 |
| 311 | Ac-ITATIEAVHEVTDGLSQLAVAVGKMQQFVNDQFNN-NH2 | 308 |
| 312 | Ac-SITATIEAVHEVTDGLSQLAVAVGKMQQFVNDQFN-NH2 | 309 |
| 313 | Ac-ESITATIEAVHEVTDGLSQLAVAVGKMQQFVNDQF-NH2 | 310 |
| 314 | Ac-KESITATIEAVHEVTDGLSQLAVAVGKMQQFVNDQ-NH2 | 310 |
| 315 | Ac-LKESITATIEAVHEVTDGLSQLAVAVGKMQQFVND-NH2 | 311 |
| 316 | Ac-RLKESITATIEAVHEVTDGLSQLAVAVGKMQQFVN-NH2 | 312 |
| 317 | Ac-LRLKESITATIEAVHEVTDGLSQLAVAVGKMQQFV-NH2 | 313 |
| 318 | Ac-ILRLKESITATIEAVHEVTDGLSQLAVAVGKMQQF-NH2 | 314 |
| 319 | Ac-NILRLKESITATIEAVHEVTDGLSQLAVAVGKMQQ-NH2 | 315 |
| 320 | Ac-ANILRLKESITATIEAVHEVTDGLSQLAVAVGKMQ-NH2 | 316 |
| 321 | Ac-AANILRLKESITATIEAVHEVTDGLSQLAVAVGKM-NH2 | 317 |
| 322 | Ac-HKCDDECMNSVKNGTYDYPKYEEESKLNRNEIKGV-NH2 | 318 |
| 323 | Ac-KCDDECMNSVKNGTYDYPKYEEESKLNRNEIKGVK-NH2 | 319 |

TABLE 2-continued

| T No. | Sequence | Seq. ID No. |
|---|---|---|
| 324 | Ac-CDDECMNSVKNGTYDYPKYEEESKLNRNEIKGVKL-NH2 | 320 |
| 325 | Ac-DDECMNSVKNGTYDYPKYEEESKLNRNEIKGVKLS-NH2 | 321 |
| 326 | Ac-DECMNSVKNGTYDYPKYEEESKLNRNEIKGVKLSS-NH2 | 322 |
| 327 | Ac-ECMNSVKNGTYDYPKYEEESKLNRNEIKGVKLSSM-NH2 | 323 |
| 328 | Ac-CMNSVKNGTYDYPKYEEESKLNRNEIKGVKLSSMG-NH2 | 324 |
| 329 | Ac-MNSVKNGTYDYPKYEEESKLNRNEIKGVKLSSMGV-NH2 | 325 |
| 330 | Ac-NSVKNGTYDYPKYEEESKLNRNEIKGVKLSSMGVY-NH2 | 326 |
| 331 | Ac-SVKNGTYDYPKYEEESKLNRNEIKGVKLSSMGVYQ-NH2 | 327 |
| 332 | Ac-VKNGTYDYPKYEEESKLNRNEIKGVKLSSMGVYQI-NH2 | 328 |
| 333 | Ac-KNGTYDYPKYEEESKLNRNEIKGVKLSSMGVYQIL-NH2 | 329 |
| 334 | Ac-AFIRKSDELLHNV-NH2 | 330 |
| 335 | Ac-VVLAGAALGVATAAQITAGIALHQSMLNSQAIDNL-NH2 | 331 |
| 336 | Ac-VLAGAALGVATAAQITAGIALHQSMLNSQAIDNLR-NH2 | 332 |
| 337 | Ac-LAGAALGVATAAQITAGIALHQSMLNSQAIDNLRA-NH2 | 333 |
| 338 | Ac-AGAALGVATAAQITAGIALHQSMLNSQAIDNLRAS-NH2 | 334 |
| 339 | Ac-GAALGVATAAQITAGIALHQSMLNSQAIDNLRASL-NH2 | 335 |
| 340 | Ac-AALGVATAAQITAGIALHQSMLNSQAIDNLRASLE-NH2 | 336 |
| 341 | Ac-ALGVATAAQITAGIALHQSMLNSQAIDNLRASLET-NH2 | 337 |
| 342 | Ac-LGVATAAQITAGIALHQSMLNSQAIDNLRASLETT-NH2 | 338 |
| 343 | Ac-GVATAAQITAGIALHQSMLNSQAIDNLRASLETTN-NH2 | 339 |
| 344 | Ac-VATAAQITAGIALHQSMLNSQAIDNLRASLETTNQ-NH2 | 340 |
| 345 | Ac-ATAAQITAGIALHQSMLNSQAIDNLRASLETTNQA-NH2 | 341 |
| 346 | Ac-TAAQITAGIALHQSMLNSQAIDNLRASLETTNQAI-NH2 | 342 |
| 347 | Ac-AAQITAGIALHQSMLNSQAIDNLRASLETTNQAIE-NH2 | 343 |
| 348 | Ac-AQITAGIALHQSMLNSQAIDNLRASLETTNQAIEA-NH2 | 344 |
| 349 | Ac-QITAGIALHQSMLNSQAIDNLRASLETTNQAIEAI-NH2 | 345 |
| 350 | Ac-ITAGIALHQSMLNSQAIDNLRASLETTNQAIEAIR-NH2 | 346 |
| 351 | Ac-TAGIALHQSMLNSQAIDNLRASLETTNQAIEAIRQ-NH2 | 347 |
| 352 | Ac-AGIALHQSMLNSQAIDNLRASLETTNQAIEAIRQA-NH2 | 348 |
| 353 | Ac-GIALHQSMLNSQAIDNLRASLETTNQAIEAIRQAG-NH2 | 349 |
| 354 | Ac-IALHQSMLNSQAIDNLRASLETTNQAIEAIRQAGQ-NH2 | 350 |
| 355 | Ac-ALHQSMLNSQAIDNLRASLETTNQAIEAIRQAGQE-NH2 | 351 |
| 356 | Ac-LHQSMLNSQAIDNLRASLETTNQAIEAIRQAGQEM-NH2 | 352 |
| 357 | Ac-HQSMLNSQAIDNLRASLETTNQAIEAIRQAGQEMI-NH2 | 353 |
| 358 | Ac-QSMLNSQAIDNLRASLETTNQAIEAIRQAGQEMIL-NH2 | 354 |
| 359 | Ac-SMLNSQAIDNLRASLETTNQAIEAIRQAGQEMILA-NH2 | 355 |
| 360 | Ac-MLNSQAIDNLRASLETTNQAIEAIRQAGQEMILAV-NH2 | 356 |
| 361 | Ac-LNSQAIDNLRASLETTNQAIEAIRQAGQEMILAVQ-NH2 | 357 |
| 362 | Ac-NSQAIDNLRASLETTNQAIEAIRQAGQEMILAVQG-NH2 | 358 |
| 363 | Ac-SQAIDNLRASLETTNQAIEAIRQAGQEMILAVQGV-NH2 | 359 |
| 364 | Ac-QAIDNLRASLETTNQAIEAIRQAGQEMILAVQGVQ-NH2 | 360 |
| 365 | Ac-AIDNLRASLETTNQAIEAIRQAGQEMILAVQGVQD-NH2 | 361 |
| 366 | Ac-IDNLRASLETTNQAIEAIRQAGQEMILAVQGVQDY-NH2 | 362 |
| 367 | Ac-DNLRASLETTNQAIEAIRQAGQEMILAVQGVQDYI-NH2 | 363 |
| 368 | Ac-NLRASLETTNQAIEAIRQAGQEMILAVQGVQDYIN-NH2 | 364 |
| 369 | Ac-LRASLETTNQAIEAIRQAGQEMILAVQGVQDYINN-NH2 | 365 |
| 370 | Ac-RASLETTNQAIEAIRQAGQEMILAVQGVQDYINNE-NH2 | 366 |
| 371 | Ac-YTSVITIELSNIKENKUNGTDAVKLIKQELDKYK-NH2 | 1670 |
| 372 | Ac-TSVITIELSNIKENKUNGTDAVKLIKQELDKYKN-NH2 | 1671 |
| 373 | Ac-SVITIELSNIKENKUNGTDAVKLIKQELDKYKNA-NH2 | 1672 |
| 374 | Ac-SNIKENKUNGTDAKVKLIKQELDKYKNAVTELQLL-NH2 | 1673 |
| 375 | Ac-KENKUNGTDAKVKLIKQELDKYKNAVTELQLLMQS-NH2 | 1674 |
| 376 | Ac-CLELDKWASLWNWFC-NH2 | 372 |
| 377 | Ac-CLELDKWASLANWFC-NH2 | 373 |
| 378 | Ac-CLELDKWASLFNFFC-NH2 | 374 |
| 379 | Ac-YTSLIHSLIEESQNQQEKNEQELLELDKWASLFNFF-NH2 | 375 |
| 381 | Ac-RMKQLEDKVEELLSKNYHLENELELDKWASLWNWF-NH2 | 376 |
| 382 | Ac-KVEELLSKNYHLENELELDKWASLWNWF-NH2 | 377 |
| 383 | Ac-RMKQLEDKVEELLSKLEWIRRSNQKLDSI-NH2 | 378 |
| 384 | Ac-RMKQLEDKVEELLSKLAFIRKSDELLHNV-NH2 | 379 |
| 385 | Ac-ELEALRGELRALRGELELDKWASLWNWF-NH2 | 380 |
| 386 | Ac-LDPIDISIELNKAKSDLEESKEWIRRSNQKLDSI-NH2 | 381 |
| 387 | Ac-CNEQLSDSFPVEFFQV-NH2 | 382 |
| 388 | Ac-MAEDDPYLGRPEQMFHLDPSL-NH2 | 383 |
| 389 | Ac-EDFSSIADMDFSALLSQISS-NH2 | 384 |
| 390 | Ac-TWQEWERKVDFLEENITALLEEAQIQQEKNMYELQ-NH2 | 385 |
| 391 | Ac-WQEWERKVDFLEENITALLEEAQIQQEKNMYELQK-NH2 | 386 |
| 392 | Ac-QEWERKVDFLEENITALLEEAQIQQEKNMYELQKL-NH2 | 387 |
| 393 | Ac-EWERKVDFLEENITALLEEAQIQQEKNMYELQKLN-NH2 | 388 |
| 394 | Ac-WERKVDFLEENITALLEEAQIQQEKNMYELQKLNS-NH2 | 389 |
| 395 | Ac-ERKVDFLEENITALLEEAQIQQEKNMYELQKLNSW-NH2 | 390 |
| 396 | Ac-RKVDFLEENITALLEEAQIQQEKNMYELQKLNSWD-NH2 | 391 |
| 397 | Ac-KVDFLEENITALLEEAQIQQEKNMYELQKLNSWDV-NH2 | 392 |
| 398 | Ac-VDFLEENITALLEEAQIQQEKNMYELQKLNSWDVF-NH2 | 393 |
| 399 | Ac-DFLEENITALLEEAQIQQEKNMYELQKLNSWDVFG-NH2 | 394 |
| 400 | Ac-FLEENITALLEEAQIQQEKNMYELQKLNSWDVFGN-NH2 | 395 |

TABLE 2-continued

| T No. | Sequence | Seq. ID No. |
|---|---|---|
| 401 | Ac-LEENITALLEEAQIQQEKNMYELQKLNSWDVFGNW-NH2 | 396 |
| 402 | Ac-LEENITALLEEAQIQQEKNMYELQKLNSWDVFGNWF-NH2 | 397 |
| 403 | Ac-NEQSEEKENELYWAKEQLLDLLFNIFNQTVGAWIMQ-NH2 | 398 |
| 405 | Ac-QQQLLDVVKRQQELLRLTVWGTKNLQTRVTAIEKYLRLD-NH2 | 400 |
| 406 | Ac-QQLLDVVKRQQELLRLTVWGTKNLQTRVTAIEKYLKDQ-NH2 | 401 |
| 407 | Ac-QQLLDVVKRQQELLRLTVWGPKNLQTRVTAIEKYLKDQ-NH2 | 402 |
| 408 | Ac-DERKQDKVLVVQQTGTLQLTLIQLEKTAKLQWVRLNRY-NH2 | 403 |
| 409 | Ac-QQQLLDVVKRQQELLRLTVWGTKNLQTRVTAIEKY-NH2 | 404 |
| 410 | Ac-QQLLDVVKRQQELLRLTVWGTKNLQTRVTAIEKYL-NH2 | 405 |
| 411 | Ac-QLLDVVKRQQELLRLTVWGTKNLQTRVTAIEKYLK-NH2 | 406 |
| 412 | Ac-LLDVVKRQQELLRLTVWGTKNLQTRVTAIEKYLKD-NH2 | 407 |
| 413 | Ac-LDVVKRQQELLRLTVWGTKNLQTRVTAIEKYLKDQ-NH2 | 408 |
| 414 | Ac-DVVKRQQELLRLTVWGTKNLQTRVTAIEKYLKDQA-NH2 | 409 |
| 415 | Ac-VVKRQQELLRLTVWGTKNLQTRVTAIEKYLKDQAQ-NH2 | 410 |
| 416 | Ac-VKRQQELLRLTVWGTKNLQTRVTAIEKYLKDQAQL-NH2 | 411 |
| 417 | Ac-KRQQELLRLTVWGTKNLQTRVTAIEKYLKDQAQLN-NH2 | 412 |
| 418 | Ac-RQQELLRLTVWGTKNLQTRVTAIEKYLKDQAQLNA-NH2 | 413 |
| 419 | Ac-QQELLRLTVWGTKNLQTRVTAIEKYLKDQAQLNAW-NH2 | 414 |
| 420 | Ac-QELLRLTVWGTKNLQTRVTAIEKYLKDQAQLNAWG-NH2 | 415 |
| 421 | Ac-ELLRLTVWGTKNLQTRVTAIEKYLKDQAQLNAWGC-NH2 | 416 |
| 422 | Ac-NNLLRAIEAQQHLLQLTVWGPKQLQARILAVERYLKDQ-NH2 | 417 |
| 423 | Ac-SELEIKRYKNRVASRKCRAKFKQLLQHYREVAAAK-NH2 | 418 |
| 424 | Ac-ELEIKRYKNRVASRKCRAKFKQLLQHYREVAAAKS-NH2 | 419 |
| 425 | Ac-LEIKRYKNRVASRKCRAKFKQLLQHYREVAAAKSS-NH2 | 420 |
| 426 | Ac-EIKRYKNRVASRKCRAKFKQLLQHYREVAAAKSSE-NH2 | 421 |
| 427 | Ac-IKRYKNRVASRKCRAKFKQLLQHYREVAAAKSSEN-NH2 | 422 |
| 428 | Ac-KRYKNRVASRKCRAKFKQLLQHYREVAAAKSSEND-NH2 | 423 |
| 429 | Ac-RYKNRVASRKCRAKFKQLLQHYREVAAAKSSENDR-NH2 | 424 |
| 430 | Ac-YKNRVASRKCRAKFKQLLQHYREVAAAKSSENDRL-NH2 | 425 |
| 431 | Ac-KNRVASRKCRAKFKQLLQHYREVAAAKSSENDRLR-NH2 | 426 |
| 432 | Ac-NRVASRKCRAKFKQLLQHYREVAAAKSSENDRLRL-NH2 | 427 |
| 433 | Ac-RVASRKCRAKFKQLLQHYREVAAAKSSENDRLRLL-NH2 | 428 |
| 434 | Ac-VASRKCRAKFKQLLQHYREVAAAKSSENDRLRLLL-NH2 | 429 |
| 435 | Ac-ASRKCRAKFKQLLQHYREVAAAKSSENDRLRLLLK-NH2 | 430 |
| 436 | Ac-SRKCRAKFKQLLQHYREVAAAKSSENDRLRLLLKQ-NH2 | 431 |
| 437 | Ac-RKCRAKFKQLLQHYREVAAAKSSENDRLRLLLKQM-NH2 | 432 |
| 438 | Ac-KCRAKFKQLLQHYREVAAAKSSENDRLRLLLKQMC-NH2 | 433 |
| 439 | Ac-CRAKFKQLLQHYREVAAAKSSENDRLRLLLKQMCP-NH2 | 434 |
| 440 | Ac-RAKFKQLLQHYREVAAAKSSENDRLRLLLKQMCPS-NH2 | 435 |
| 441 | Ac-AKFKQLLQHYREVAAAKSSENDRLRLLLKQMCPSL-NH2 | 436 |
| 442 | Ac-KFKQLLQHYREVAAAKSSENDRLRLLLKQMCPSLD-NH2 | 437 |
| 443 | Ac-FKQLLQHYREVAAAKSSENDRLRLLLKQMCPSLDV-NH2 | 438 |
| 444 | Ac-KQLLQHYREVAAAKSSENDRLRLLLKQMCPSLDVD-NH2 | 439 |
| 445 | Ac-QLLQHYREVAAAKSSENDRLRLLLKQMCPSLDVDS-NH2 | 440 |
| 446 | Ac-LLQHYREVAAAKSSENDRLRLLLKQMCPSLDVDSI-NH2 | 441 |
| 447 | Ac-LQHYREVAAAKSSENDRLRLLLKQMCPSLDVDSII-NH2 | 442 |
| 448 | Ac-QHYREVAAAKSSENDRLRLLLKQMCPSLDVDSIIP-NH2 | 443 |
| 449 | Ac-HYREVAAAKSSENDRLRLLLKQMCPSLDVDSIIPR-NH2 | 444 |
| 450 | Ac-YREVAAAKSSENDRLRLLLKQMCPSLDVDSIIPRT-NH2 | 445 |
| 451 | Ac-REVAAAKSSENDRLRLLLKQMCPSLDVDSIIPRTP-NH2 | 446 |
| 452 | Ac-EVAAAKSSENDRLRLLLKQMCPSLDVDSIIPRTPD-NH2 | 447 |
| 453 | Ac-VAAAKSSENDRLRLLLKQMCPSLDVDSIIPRTPDV-NH2 | 448 |
| 454 | Ac-AAAKSSENDRLRLLLKQMCPSLDVDSIIPRTPDVL-NH2 | 449 |
| 455 | Ac-AAKSSENDRLRLLLKQMCPSLDVDSIIPRTPDVLH-NH2 | 450 |
| 456 | Ac-AKSSENDRLRLLLKQMCPSLDVDSIIPRTPDVLHE-NH2 | 451 |
| 457 | Ac-KSSENDRLRLLLKQMCPSLDVDSIIPRTPDVLHED-NH2 | 452 |
| 458 | Ac-SSENDRLRLLLKQMCPSLDVDSIIPRTPDVLHEDL-NH2 | 453 |
| 459 | Ac-SENDRLRLLLKQMCPSLDVDSIIPRTPDVLHEDLL-NH2 | 454 |
| 460 | Ac-ENDRLRLLLKQMCPSLDVDSIIPRTPDVLHEDLLN-NH2 | 455 |
| 461 | Ac-NDRLRLLLKQMCPSLDVDSIIPRTPDVLHEDLLNF-NH2 | 456 |
| 534 | Ac-PGYRWMCLRRFIIFLFILLLCLIFLLVLLDYQGML-NH2 | 458 |
| 535 | Ac-GYRWMCLRRFIIFLFILLLCLIFLLVLLDYQGMLP-NH2 | 459 |
| 536 | Ac-YRWMCLRRFIIFLFILLLCLIFLLVLLDYQGMLPV-NH2 | 460 |
| 537 | Ac-RWMCLRRFIIFLFILLLCLIFLLVLLDYQGMLPVC-NH2 | 461 |
| 538 | Ac-WMCLRRFIIFLFILLLCLIFLLVLLDYQGMLPVCP-NH2 | 462 |
| 539 | Ac-MCLRRFIIFLFILLLCLIFLLVLLDYQGMLPVCPL-NH2 | 463 |
| 540 | Ac-CLRRFIIFLFILLLCLIFLLVLLDYQGMLPVCPLI-NH2 | 464 |
| 541 | Ac-LRRFIIFLFILLLCLIFLLVLLDYQGMLPVCPLIP-NH2 | 465 |
| 542 | Ac-RRFIIFLFILLLCLIFLLVLLDYQGMLPVCPLIPG-NH2 | 466 |
| 543 | Ac-RFIIFLFILLLCLIFLLVLLDYQGMLPVCPLIPGS-NH2 | 467 |
| 544 | Ac-FIIFLFILLLCLIFLLVLLDYQGMLPVCPLIPGSS-NH2 | 468 |
| 545 | Ac-IIFLFILLLCLIFLLVLLDYQGMLPVCPLIPGSST-NH2 | 469 |
| 546 | Ac-IFLFILLLCLIFLLVLLDYQGMLPVCPLIPGSSTT-NH2 | 470 |
| 547 | Ac-FLFILLLCLIFLLVLLDYQGMLPVCPLIPGSSTTS-NH2 | 471 |
| 548 | Ac-LFILLLCLIFLLVLLDYQGMLPVCPLIPGSSTTST-NH2 | 472 |
| 549 | Ac-FILLLCLIFLLVLLDYQGMLPVCPLIPGSSTTSTG-NH2 | 473 |

TABLE 2-continued

| T No. | Sequence | Seq. ID No. |
|---|---|---|
| 550 | Ac-ILLLCLIFLLVLLDYQGMLPVCPLIPGSSTTSTGP-NH2 | 474 |
| 551 | Ac-LLLCLIFLLVLLDYQGMLPVCPLIPGSSTTSTGPC-NH2 | 475 |
| 552 | Ac-LLCLIFLLVLLDYQGMLPVCPLIPGSSTTSTGPCR-NH2 | 476 |
| 553 | Ac-LCLIFLLVLLDYQGMLPVCPLIPGSSTTSTGPCRT-NH2 | 477 |
| 554 | Ac-CLIFLLVLLDYQGMLPVCPLIPGSSTTSTGPCRTC-NH2 | 478 |
| 555 | Ac-LIFLLVLLDYQGMLPVCPLIPGSSTTSTGPCRTCM-NH2 | 479 |
| 556 | Ac-IFLLVLLDYQGMLPVCPLIPGSSTTSTGPCRTCMT-NH2 | 480 |
| 557 | Ac-FLLVLLDYQGMLPVCPLIPGSSTTSTGPCRTCMTT-NH2 | 481 |
| 558 | Ac-PPLVLQAGFFLLTRILTIPQSLDSWWTSLNFLGGT-NH2 | 1675 |
| 559 | Ac-LLVLQAGFFLLTRILTIPQSLDSWWTSLNFLGGTT-NH2 | 483 |
| 560 | Ac-LVLQAGFFLLTRILTIPQSLDSWWTSLNFLGGTTV-NH2 | 484 |
| 561 | Ac-VLQAGFFLLTRILTIPQSLDSWWTSLNFLGGTTVC-NH2 | 485 |
| 562 | Ac-LQAGFFLLTRILTIPQSLDSWWTSLNFLGGTTVCL-NH2 | 486 |
| 563 | Ac-QAGFFLLTRILTIPQSLDSWWTSLNFLGGTTVCLG-NH2 | 487 |
| 564 | Ac-AGFFLLTRILTIPQSLDSWWTSLNFLGGTTVCLGQ-NH2 | 488 |
| 565 | Ac-GFFLLTRILTIPQSLDSWWTSLNFLGGTTVCLGQN-NH2 | 489 |
| 566 | Ac-FFLLTRILTIPQSLDSWWTSLNFLGGTTVCLGQNS-NH2 | 490 |
| 567 | Ac-FLLTRILTIPQSLDSWWTSLNFLGGTTVCLGQNSQ-NH2 | 491 |
| 568 | Ac-LLTRILTIPQSLDSWWTSLNFLGGTTVCLGQNSQS-NH2 | 492 |
| 569 | Ac-LTRILTIPQSLDSWWTSLNFLGGTTVCLGQNSQSP-NH2 | 493 |
| 570 | Ac-FWNWLSAWKDLELKSLLEEVKDELQKMR-NH2 | 494 |
| 571 | Ac-NNLLRAIEAQQHLLQLTVW-NH2 | 495 |
| 572 | Ac-CGGNNLLRAIEAQQHLLQLTVWGIKQLQARILAVERYLKDQ-NH2 | 496 |
| 573 | Ac-YTSLIHSLIEESQNQQEKNEQELLELDKWASLWNWF-NH2 | 497 |
| 574 | C13H27CO-YTSLIHSLIEESQNQQEKNEQELLELDKWASLWNWF-NH2 | 498 |
| 575 | Ac-AVSKGYLSALRTGWYTSVITIELSNIKENKUNGTDA-NH2 | 1676 |
| 576 | Ac-SISINIETVIEFQQKNNRLLEITREFSVNAGVTTPVS-NH2 | 500 |
| 577 | Ac-DQQIKQYKRLLDRLIIPLYDGLRQKDVIVSNQESN-NH2 | 501 |
| 578 | Ac-YSELTNIFGDNIGSLQEKGIKLQGIASLYRTNITEI-NH2 | 502 |
| 579 | Ac-TSITLQVRLPLLTRLLNTQIYRVDSISYNIQNREWY-NH2 | 503 |
| 580 | Ac-VEIAEYRRLLRTVLEPIRDALNAMTQNIRPVQSVA-NH2 | 504 |
| 581 | Ac-SYFIVLSIAYPTLSEIKGVIVHRLEGVSYNIGSQEW-NH2 | 505 |
| 582 | Ac-LKEAIRDTNKAVQSVQSSIGNLIVAIKS-NH2 | 506 |
| 583 | NNLLRAIEAQQHLLQLTVWGIKQLQARILAVERYLKDQ | 507 |
| 583 | NNLLRAIEAQQHLLQLTVWGIKQLQARILAVERYLKDQ | 507 |
| 584 | QKQEPIDKELYPLTSL | 508 |
| 585 | YPKFVKQNTLKLAT | 509 |
| 586 | QYIKANQKFIGITE | 510 |
| 587 | NGQIGNDPNRDILY | 511 |
| 588 | Ac-RPDVY-OH | 512 |
| 589 | CLELDKWASLWNWFC-(cyclic) | 513 |
| 590 | CLELDKWASLANWFC-(cyclic) | 514 |
| 591 | CLELDKWASLANFFC-(cyclic) | 515 |
| 594 | Ac-NNLLRAIEAQQQHLLQLTVWGIKQLQARILAVERYLKDQ-NH2 | 516 |
| 595 | Ac-CGGYTSLIHSLIEESQNQQEKNEQELLELDKWASLWNNWF-NH2 | 517 |
| 596 | Ac-PLLVLQAGFFLLTRILTIPQSLDSWWTSLNFLGGT-NH2 | 518 |
| 597 | Ac-LLVLQAGFFLLTRILTIPQSLDSWWTSLNFLGGTT-NH2 | 519 |
| 598 | Ac-LVLQAGFFLLTRILTIPQSLDSWWTSLNFLGGTTV-NH2 | 520 |
| 599 | Ac-VLQAGFFLLTRILTIPQSLDSWWTSLNFLGGTTVC-NH2 | 521 |
| 600 | Ac-LQAGFFLLTRILTIPQSLDSWWTSLNFLGGTTVCL-NH2 | 522 |
| 601 | Ac-QAGFFLLTRILTIPQSLDSWWTSLNFLGGTTVCLG-NH2 | 523 |
| 602 | Ac-AGFFLLTRILTIPQSLDSWWTSLNFLGGTTVCLGQ-NH2 | 524 |
| 603 | Ac-GFFLLTRILTIPQSLDSWWTSLNFLGGTTVCLGQN-NH2 | 525 |
| 604 | Ac-FFLLTRILTIPQSLDSWWTSLNFLGGTTVCLGQNS-NH2 | 526 |
| 605 | Ac-FLLTRILTIPQSLDSWWTSLNFLGGTTVCLGQNSQ-NH2 | 527 |
| 606 | Ac-LLTRILTIPQSLDSWWTSLNFLGGTTVCLGQNSQS-NH2 | 528 |
| 607 | Ac-LTRILTIPQSLDSWWTSLNFLGGTTVCLGQNSQSP-NH2 | 529 |
| 608 | Ac-LELDKWASLWNWA-NH2 | 530 |
| 609 | Ac-LELDKWASAWNWF-NH2 | 531 |
| 610 | Ac-LELDKAASLWNWF-NH2 | 532 |
| 611 | Ac-LKLDKWASLWNWF-NH2 | 533 |
| 612 | Ac-LELKKWASLWNWF-NH2 | 534 |
| 613 | Ac-DELLHNVAGKST-NH2 | 535 |
| 614 | Ac-KSDELLHNVAGKST-NH2 | 536 |
| 615 | Ac-IRKSDELLHNVAGKST-NH2 | 537 |
| 616 | Ac-AFIRKSDELLHNVAGKST-NH2 | 538 |
| 617 | Ac-FDASISQVNEKINQSLAFI-NH2 | 539 |
| 618 | Ac-YAADKESTQKAFDGITNKVNSVIEKMNTQFEAVGKE-NH2 | 540 |
| 619 | Ac-SVIEKMNTQFEAVGKEFGNLERRLENLNKRMEDGFL-NH2 | 541 |
| 620 | Ac-VWTYNAELLVLMENERTLDFHDSNVKNLYDKVRMQL-NH2 | 542 |
| 621 | Ac-EWDREINNYTSLIHSLIEESQNQQEKNEQEGGC-NH2 | 543 |
| 622 | Ac-INNYTSLIHSLIEESQNQQEKNEQELLELDKWASL-NH2 | 544 |
| 623 | Ac-INNYTSLIHSLIEESQNQQEKNEQELLE-NH2 | 545 |
| 624 | Ac-WMEWDREINNYTSLIHSLIEESQNQQEKNEQELLE-NH2 | 546 |
| 625 | Ac-MTWMEWDREINNYTSLIHSLIEESQNQQEKNEQELLELDKWASLWNWF-NH2 | 547 |
| 626 | Ac-IDISIELNKAKSDLEESKEWIKKSNQKLDSIGNWH-NH2 | 548 |

TABLE 2-continued

| T No. | Sequence | Seq. ID No. |
|---|---|---|
| 627 | Ac-NQQEKNEQELLELDKWASLWNWFNITNWLWYIKIFI-NH2 | 549 |
| 627 | Ac-NQQEKNEQELLELDKWASLWNWFNITNWLWYIKIFI-NH2 | 549 |
| 628 | Ac-QNQQEKNEQELLELDKWASLWNWFNITNWLWYIKIF-NH2 | 550 |
| 629 | Ac-SQNQQEKNEQELLELDKWASLWNWFNITNWLWYIKI-NH2 | 551 |
| 630 | Ac-ESQNQQEKNEQELLELDKWASLWNWFNITNWLWYIK-NH2 | 552 |
| 631 | Ac-EESQNQQEKNEQELLELDKWASLWNWFNITNWLWYI-NH2 | 553 |
| 632 | Ac-IEESQNQQEKNEQELLELDKWASLWNWFNITNWLWY-NH2 | 554 |
| 633 | Ac-LIEESQNQQEKNEQELLELDKWASLWNWFNITNWLW-NH2 | 555 |
| 634 | Ac-SLIEESQNQQEKNEQELLELDKWASLWNWFNITNWL-NH2 | 556 |
| 635 | Ac-HSLIEESQNQQEKNEQELLELDKWASLWNWFNITNW-NH2 | 557 |
| 636 | Ac-IHSLIEESQNQQEKNEQELLELDKWASLWNWFNITN-NH2 | 558 |
| 637 | Ac-LIHSLIEESQNQQEKNEQELLELDKWASLWNWFNIT-NH2 | 559 |
| 638 | Ac-SLIHSLIEESQNQQEKNEQELLELDKWASLWNWFNI-NH2 | 560 |
| 639 | Ac-TSLIHSLIEESQNQQEKNEQELLELDKWASLWNWFN-NH2 | 561 |
| 640 | Ac-NYTSLIHSLIEESQNQQEKNEQELLELDKWASLWNW-NH2 | 562 |
| 641 | Ac-NNYTSLIHSLIEESQNQQEKNEQELLELDKWASLWN-NH2 | 563 |
| 642 | Ac-INNYTSLIHSLIEESQNQQEKNEQELLELDKWASLW-NH2 | 564 |
| 643 | Ac-EINNYTSLIHSLIEESQNQQEKNEQELLELDKWASL-NH2 | 565 |
| 644 | Ac-REINNYTSLIHSLIEESQNQQEKNEQELLELDKWAS-NH2 | 566 |
| 645 | Ac-DREINNYTSLIHSLIEESQNQQEKNEQELLELDKWA-NH2 | 567 |
| 646 | Ac-WDREINNYTSLIHSLIEESQNQQEKNEQELLELDKW-NH2 | 568 |
| 647 | Ac-EWDREINNYTSLIHSLIEESQNQQEKNEQELLELDK-NH2 | 569 |
| 648 | Ac-MEWDREINNYTSLIHSLIEESQNQQEKNEQELLELD-NH | 570 |
| 649 | Ac-WMEWDREINNYTSLIHSLIEESQNQQEKNEQELLEL-NH2 | 572 |
| 650 | Ac-TWMEWDREINNYTSLIHSLIEESQNQQEKNEQELLE-NH2 | 573 |
| 651 | Ac-MTWMEWDREINNYTSLIHSLIEESQNQQEKNEQELL-NH2 | 574 |
| 652 | Ac-NMTWMEWDREINNYTSLIHSLIEESQNQQEKNEQEL-NH2 | 575 |
| 653 | Ac-NNMTWMEWDREINNYTSLIHSLIEESQNQQEKNEQE-NH2 | 576 |
| 654 | Ac-WNNMTWMEWDREINNYTSLIHSLIEESQNQQEKNEQ-NH2 | 577 |
| 655 | Ac-IWNNMTWMEWDREINNYTSLIHSLIEESQNQQEKNE-NH2 | 578 |
| 656 | Ac-QIWNNMTWMEWDREINNYTSLIHSLIEESQNQQEKN-NH2 | 579 |
| 657 | Ac-EQIWNNMTWMEWDREINNYTSLIHSLIEESQNQQEK-NH2 | 580 |
| 658 | Ac-LEQIWNNMTWMEWDREINNYTSLIHSLIEESQNQQE-NH2 | 581 |
| 659 | Ac-SLEQIWNNMTWMEWDREINNYTSLIHSLIEESQNQQ-NH2 | 582 |
| 660 | Ac-KSLEQIWNNMTWMEWDREINNYTSLIHSLIEESQNQ-NH2 | 583 |
| 661 | Ac-NKSLEQIWNNMTWMEWDREINNYTSLIHSLIEESQN-NH2 | 584 |
| 662 | Ac-SLAFIRKSDELLHNVNAGKST-NH2 | 585 |
| 663 | Ac-FDASISQVNEKINQSLAFIRK-NH2 | 586 |
| 664 | Ac-YTSLIHSLIEESQQQQEKQEQELLELDKWASLWNWF-NH2 | 587 |
| 665 | Ac-FDASISQVNEKINQSLAFIRKSDELLHNVNAGK-NH2 | 588 |
| 666 | Ac-FDASISQVNEKINQSLAFIRKSDELLHNVNA-NH2 | 589 |
| 667 | Ac-FDASISQVNEKINQSLAFIRKSDELLHNV-NH2 | 590 |
| 668 | Ac-FDASISQVNEKINQSLAFIRKSDELLH-NH2 | 591 |
| 669 | Ac-FDASISQVNEKINQSLAFIRKSDEL-NH2 | 592 |
| 670 | Ac-FDASISQVNEKINQSLAFIRKSD-NH2 | 593 |
| 671 | Ac-ASISQVNEKINQSLAFIRKSDELLHNVNAGKST-NH2 | 594 |
| 672 | Ac-ISQVNEKINQSLAFIRKSDELLHNVNAGKST-NH2 | 595 |
| 673 | Ac-QVNEKINQSLAFIRKSDELLHNVNAGKST-NH2 | 596 |
| 674 | Ac-NEKINQSLAFIRKSDELLHNVNAGKST-NH2 | 597 |
| 675 | Ac-KINQSLAFIRKSDELLHNVNAGKST-NH2 | 598 |
| 676 | Ac-NQSLAFIRKSDELLHNVNAGKST-NH2 | 599 |
| 677 | Ac-FWNWLSAWKDLELYPGSLELDKWASLWNWF-NH2 | 600 |
| 678 | Ac-CGGNNLLRAIEAQQHLLQLTVWGIKQLQARILAVERYLKDQ-NH2 | 601 |
| 679 | Ac-CGGYTSLIHSLIEESQNQQEKNEQELLELDKWASLWNWF-NH2 | 602 |
| 680 | YTSLIHSLIEESQNQQEKNEQELLELDKWASLWNWF | 603 |
| 681 | NNLLRAIEAQQHLLQLTVWGIKQLQARILAVERYLKDQ | 604 |
| 682 | Ac-EKNMYELQKLNSWDVFTNWLDFTSWVRYIQYIQYGV-NH2 | 605 |
| 683 | Ac-QEKNMYELQKLNSWDVFTNWLDFTSWVRYIQYIQYG-NH2 | 606 |
| 684 | Ac-QQEKNMYELQKLNSWDVFTNWLDFTSWVRYIQYIQY-NH2 | 607 |
| 685 | Ac-IQQEKNMYELQKLNSWDVFTNWLDFTSWVRYIQYIQ-NH2 | 608 |
| 686 | Ac-QIQQEKNMYELQKLNSWDVFTNWLDFTSWVRYIQYI-NH2 | 609 |
| 687 | Ac-AQIQQEKNMYELQKLNSWDVFTNWLDFTSWVRYIQY-NH2 | 610 |
| 688 | Ac-QAQIQQEKNMYELQKLNSWDVFTNWLDFTSWVRYIQ-NH2 | 611 |
| 689 | Ac-EQAQIQQEKNMYELQKLNSWDVFTNWLDFTSWVRYI-NH2 | 612 |
| 690 | Ac-LEQAQIQQEKNMYELQKLNSWDVFTNWLDFTSWVRY-NH2 | 613 |
| 691 | Ac-SLEQAQIQQEKNMYELQKLNSWDVFTNWLDFTSWVR-NH2 | 614 |
| 692 | Ac-QSLEQAQIQQEKNMYELQKLNSWDVFTNWLDFTSWV-NH2 | 615 |
| 693 | Ac-SQSLEQAQIQQEKNMYELQKLNSWDVFTNWLDFTSW-NH2 | 616 |
| 694 | Ac-ISQSLEQAQIQQEKNMYELQKLNSWDVFTNWLDFTS-NH2 | 617 |
| 695 | Ac-NISQSLEQAQIQQEKNMYELQKLNSWDVFTNWLDFT-NH2 | 618 |
| 696 | Ac-ANISQSLEQAQIQQEKNMYELQKLNSWDVFTNWLDF-NH2 | 619 |
| 697 | Ac-EANISQSLEQAQIQQEKNMYELQKLNSWDVFTNWLD-NH2 | 620 |
| 699 | Ac-YLEANISQSLEQAQIQQEKNMYELQKLNSWDVFTNW-NH2 | 622 |
| 700 | Ac-YTSLIHSLIEESQNQQEKNEQEL-NH2 | 623 |
| 701 | Ac-YTSLIHSLIEESQNLQEKNEQELLELDKWASLWNWF-NH2 | 624 |
| 702 | Ac-YTSLIHSLIEESQNQQEKLEQELLELDKWASLWNWF-NH2 | 625 |

TABLE 2-continued

| T No. | Sequence | Seq. ID No. |
|---|---|---|
| 703 | Ac-YTSLIHSLIEESQNQQEKNEQELLEFDKWASLWNWF-NH2 | 626 |
| 704 | Ac-YTSLIHSLIEESQNQQEKNEQELLELDKPASLWNWF-NH2 | 627 |
| 705 | Ac-YTSLIHSLIEESQNQQEKNEQELLELDKWASPWNWF-NH2 | 628 |
| 706 | Ac-YTSLIHSLIEESQNQQEKNEQELLELDKWASLWNSF-NH2 | 629 |
| 707 | Biotin NH(CH2)4CO-YTSLIHSLIEESQNQQEKNEQELLELDKWASLWNWF-NH2 | 705 |
| 708 | Biotin NH(CH2)6CO-YTSLIHSLIEESQNQQEKNEQELLELDKWASLWNWF-NH2 | 630 |
| 709 | FMOC-YTSLIHSLIEESQNQQEKNEQELLELDKWASLWNWF | 497 |
| 710 | FMOC-NNLLRAIEAQQHLLQLTVWGIKQLQARILAVERYLKDQ | 16 |
| 711 | Ac-EWDREINNYTSLIHSLIEESQNQQEKNEQE-NH2 | 634 |
| 712 | Ac-LIEESQNQQEKNEQELLELDKWASLWNWF-NH2 | 635 |
| 713 | Ac-FWNWLSAWKDLELGGPGSGPGGLELDKWASLWNWF-NH2 | 636 |
| 714 | Ac-LIHSLIEESQNQQEKNEQELLELDKWASL-NH2 | 637 |
| 715 | Ac-TSLIHSLIEESQNQQEKNEQELLELDKWASLWNWF-NH2 | 638 |
| 716 | Ac-LIHSLIEESQNQQEKNEQELLELDKWASLWNWF-NH2 | 639 |
| 718 | FMOC-GGGGGYTSLIHSLIEESQNQQEKNEQELLELDKWASLWNWF-NH2 | 640 |
| 719 | Ac-HSLIEESQNQQEKNEQELLELDKWASLWNWF-NH2 | 641 |
| 720 | Ac-YTSLIYSLIEESQNQQEKNEQELLELDKWASLWNWF-NH2 | 642 |
| 721 | Ac-YTSLIHSLIEKSQNQQEKNEQELLELDKWASLWNWF-NH2 | 643 |
| 722 | Ac-YTSLIHSSIEESQNQQEKNEQELLELDKWASLWNWF-NH2 | 644 |
| 723 | Ac-LEANISQLLEQAQIQQEKNMYELQKLNSWDVFTNWL-NH2 | 645 |
| 724 | Ac-SLEECDSELEIKRYKNRVASRKCRAKFKQLLQHYR-NH2 | 646 |
| 725 | Ac-LEECDSELEIKRYKNRVASRKCRAKFKQLLQHYRE-NH2 | 647 |
| 726 | Ac-EECDSELEIKRYKNRVASRKCRAKFKQLLQHYREV-NH2 | 648 |
| 727 | Ac-ECDSELEIKRYKNRVASRKCRAKFKQLLQHYREVA-NH2 | 649 |
| 728 | Ac-CDSELEIKRYKNRVASRKCRAKFKQLLQHYREVAA-NH2 | 650 |
| 729 | Ac-DSELEIKRYKNRVASRKCRAKFKQLLQHYREVAAA-NH2 | 651 |
| 730 | Desaminotyrosine-FDASISQVNEKINQSLAFIRKSDELLHNVNAGKST-NH2 | 679 |
| 731 | WASLWNW-NH2 | 653 |
| 732 | Ac-EAQQHLLQLTVWGIKQLQARILAVERYLKDQQLLGIWG-NH2 | 654 |
| 733 | Ac-IEAQQHLLQLTVWGIKQLQARILAVERYLKDQQLLGIW-NH2 | 655 |
| 734 | Ac-AIEAQQHLLQLTVWGIKQLQARILAVERYLKDQQLLGI-NH2 | 656 |
| 735 | Ac-RAIEAQQHLLQLTVWGIKQLQARILAVERYLKDQQLLG-NH2 | 657 |
| 736 | Ac-LRAIEAQQHLLQLTVWGIKQLQARILAVERYLKDQQLL-NH2 | 658 |
| 737 | Ac-LLRAIEAQQHLLQLTVWGIKQLQARILAVERYLKDQQL-NH2 | 659 |
| 738 | Ac-NLLRAIEAQQHLLQLTVWGIKQLQARILAVERYLKDQQ-NH2 | 660 |
| 739 | Ac-QNNLLRAIEAQQHLLQLTVWGIKQLQARILAVERYLKD-NH2 | 661 |
| 740 | Ac-QQNNLLRAIEAQQHLLQLTVWGIKQLQARILAVERYLK-NH2 | 662 |
| 741 | Ac-QQQNNLLRAIEAQQHLLQLTVWGIKQLQARILAVERYL-NH2 | 663 |
| 742 | Ac-VQQQNNLLRAIEAQQHLLQLTVWGIKQLQARILAVERY-NH2 | 664 |
| 743 | Ac-IVQQQNNLLRAIEAQQHLLQLTVWGIKQLQARILAVER-NH2 | 665 |
| 744 | Ac-GIVQQQNNLLRAIEAQQHLLQLTVWGIKQLQARILAVE-NH2 | 666 |
| 745 | Ac-SGIVQQQNNLLRAIEAQQHLLQLTVWGIKQLQARILAV-NH2 | 667 |
| 758 | Ac-RSMTLTVQARQLLSGIVQQQNNLLRAIEAQQHLLQLTV-NH2 | 668 |
| 760 | Ac-GARSMTLTVQARQLLSGIVQQQNNLLRAIEAQQHLLQL-NH2 | 669 |
| 764 | Ac-GSTMGARSMTLTVQARQLLSGIVQQQNNLLRAIEAQQH-NH2 | 670 |
| 765 | Ac-GSTMGARSMTLTVQARQLLSGIVQQQNNLLRAIEAQQ-NH2 | 671 |
| 766 | Ac-EGSTMGARSMTLTVQARQLLSGIVQQQNNLLRAIEAQQ-NH2 | 672 |
| 767 | Ac-RAKFKQLLQHYREVAAAKSSENDRLRLL-NH2 | 673 |
| 768 | Ac-AKFKQLLQHYREVAAAKSSENDRLRLLL-NH2 | 674 |
| 769 | Ac-KFKQLLQHYREVAAAKSSENDRLRLLLK-NH2 | 675 |
| 770 | Ac-FKQLLQHYREVAAAKSSENDRLRLLLKQ-NH2 | 676 |
| 771 | Ac-RAKFKQELQHYREVAAAKSSENDRLRLLLKQMCPS-NH2 | 677 |
| 772 | DKWASLWNWF-NH2 | 678 |
| 773 | Biotin-FDASISQVNEKINQSLAFIRKSDELLHNVNAGKST-NH2 | 679 |
| 774 | Ac-YDASISQVNEKINQSLAFIRKSDELLHNVNAGKST-NH2 | 680 |
| 775 | Ac-YDASISQVNEKINQSLAYIRKSDELLHNVNAGKST-NH2 | 681 |
| 776 | Ac-FDASISQVNEKINQSLAYIRKSDELLHNVNAGKST-NH2 | 682 |
| 777 | Ac-FDASISQVQEKIQQSLAFIRKSDELLHQVQAGKST-NH2 | 683 |
| 778 | Ac-FDASISQVNEKINQALAFIRKADELLHNVNAGKST-NH2 | 684 |
| 779 | Ac-FDASISQVNEKINQALAFIRKSDELLHNVNAGKST-NH2 | 685 |
| 780 | Ac-FDASISQVNEKINQSLAFIRKADELLHNVNAGKST-NH2 | 686 |
| 781 | Ac-YDASISQVQEEIQQALAFIRKADELLEQVQAGKST-NH2 | 687 |
| 782 | Ac-FDASISQVNEKINQSLAFIRKSDELLENVNAGKST-NH2 | 688 |
| 783 | Ac-FDASISQVNEEINQSLAFIRKSDELLHNVNAGKST-NH2 | 689 |
| 784 | Ac-VFPSDEFDASISQVNEKINQSLAFIRKSDELLENV-NH2 | 690 |
| 785 | Ac-VFPSDEFDASISQVNEEINQSLAFIRKSDELLENV-NH2 | 691 |
| 786 | Ac-VYPSDEYDASISQVNEEINQALAYIRKADELLENV-NH2 | 692 |
| 787 | Ac-VFPSDEFDASISQVNEEINQSLAFIRKSDELLHNV-NH2 | 693 |
| 788 | Ac-SNKSLEQIWNNMTWMEWDREINNYTSLIHSLIEESQ-NH2 | 694 |
| 789 | Ac-WSNKSLEQIWNNMTWMEWDREINNYTSLIHSLIEES-NH2 | 695 |
| 790 | Ac-SWSNKSLEQIWNNMTWMEWDREINNYTSLIHSLIEE-NH2 | 696 |
| 791 | Ac-ASWSNKSLEQIWNNMTWMEWDREINNYTSLIHSLIE-NH2 | 697 |
| 792 | Ac-NASWSNKSLEQIWNNMTWMEWDREINNYTSLIHSLI-NH2 | 698 |
| 793 | Ac-WNASWSNKSLEQIWNNMTWMEWDREINNYTSLIHSL-NH2 | 699 |
| 793 | Ac-WNASWSNKSLEQIWNNMTWMEWDREINNYTSLIHSL-NH2 | 699 |
| 794 | Ac-PWNASWSNKSLEQIWNNMTWMEWDREINNYTSLIHS-NH2 | 700 |

TABLE 2-continued

| T No. | Sequence | Seq. ID No. |
|---|---|---|
| 795 | Ac-VPWNASWSNKSLEQIWNNMTWMEWDREINNYTSLIH-NH2 | 701 |
| 796 | Ac-AVPWNASWSNKSLEQIWNNMTWMEWDREINNYTSLI-NH2 | 702 |
| 797 | Ac-TAVPWNASWSNKSLEQIWNNMTWMEWDREINNYTSL-NH2 | 703 |
| 798 | Ac-TTAVPWNASWSNKSLEQIWNNMTWMEWDREINNYTS-NH2 | 704 |
| 800 | Ac-AAASDEFDASISQVNEKINQSLAFIRKSDELLHNV-NH2 | 706 |
| 801 | Ac-VFPAAAFDASISQVNEKINQSLAFIRKSDELLHNV-NH2 | 707 |
| 802 | Ac-VFPSDEAAASISQVNEKINQSLAFIRKSDELLHNV-NH2 | 708 |
| 803 | Ac-VFPSDEFDAAAAQVNEKINQSLAFIRKSDELLHNV-NH2 | 709 |
| 804 | Ac-VFPSDEFDASISAAAEKINQSLAFIRKSDELLHNV-NH2 | 710 |
| 805 | Ac-VFPSDEFDASISQVNAAANQSLAFIRKSDELLHNV-NH2 | 711 |
| 806 | Ac-VFPSDEFDASISQVNEKIAAALAFIRKSDELLHNV-NH2 | 712 |
| 807 | Ac-VFPSDEFDASISQVNEKINQSAAAIRKSDELLHNV-NH2 | 713 |
| 808 | Ac-VFPSDEFDASISQVNEKINQSLAFAAASDELLHNV-NH2 | 714 |
| 809 | Ac-VFPSDEFDASISQVNEKINQSLAFIRKAAALLHNV-NH2 | 715 |
| 810 | Ac-VFPSDEFDASISQVNEKINQSLAFIRKSDEAAANV-NH2 | 716 |
| 811 | Ac-VFPSDEFDASISQVNEKINQSLAFIRKSDELLAAA-NH2 | 717 |
| 812 | Ac-VYPSDEFDASISQVNEKINQSLAFIRKSDELLHNV-NH2 | 718 |
| 813 | Ac-AAAAIHSLIEESQNQQEKNEQELLELDKWASLWNWF-NH2 | 719 |
| 814 | Ac-YTSLIHSLIEESQQQQEKNEQELLELDKWASLWNWF-NH2 | 720 |
| 815 | Ac-YTSLIHSLIEESQNQQEKQEQELLELDKWASLWNWF-NH2 | 721 |
| 816 | Ac-QIWNNMTWMEWDKEINNYTSLIHSLIEESQNQQEKQ-NH2 | 722 |
| 817 | Ac-QIWNNMTWMEWDREINNYTSLIHSLIEESQQQQEKN-NH2 | 723 |
| 818 | Ac-QIWNNMTWMEWDREINNYTSLIHSLIEESQQQQEKQ-NH2 | 724 |
| 819 | Ac-NKSLEQIWNNMTWMEWDREINNYTSLIHSLIEESQQ-NH2 | 725 |
| 820 | Ac-FDASISQVNEKINQSLAFIEESDELLHNVNAGKST-NH2 | 726 |
| 821 | Ac-ACIRKSDELCL-NH2 | 727 |
| 823 | Ac-YTSLIHSLIEESQNQQEKDEQELLELDKWASLWNWF-NH2 | 728 |
| 824 | Ac-YTSLIHSLIEESQDQQEKNEQELLELDKWASLWNWF-NH2 | 729 |
| 825 | Ac-YTSLIHSLIEESQDQQEKDEQELLELDKWASLWNWF-NH2 | 730 |
| 826 | Ac-YTSLIHSLIEESQNQQEKNEQELLELDKWASLWDWF-NH2 | 731 |
| 841 | Ac-LEANITQSLEQAQIQQEKNMYELQKLNSWDVFTNWL-NH2 | 732 |
| 842 | Ac-LEANISASLEQAQIQQEKNMYELQKLNSWDVFTNWL-NH2 | 733 |
| 843 | Ac-LEANISALLEQAQIQQEKNMYELQKLNSWDVFTNWL-NH2 | 734 |
| 844 | Ac-LEANITALLEQAQIQQEKNMYELQKLNSWDVFTNWL-NH2 | 735 |
| 845 | Ac-LEANITASLEQAQIQQEKNMYELQKLNSWDVFTNWL-NH2 | 736 |
| 845 | Ac-LEANITASLEQAQIQQEKNMYELQKLNSWDVFTNWL-NH2 | 736 |
| 846 | Ac-RAKFKQLLQHYREVAAAKSSENDRLRLLLKQMUPS-NH2 | 1677 |
| 847 | Ac-Abu—DDE—Abu-MNSVKNGTYDYPKYEEESKLNRNEIKGVKL-NH2 | 1678 |
| 856 | Ac-WQEWEQKVRYLEANISQSLEQAQIQQEKNMYELQKL-NH2 | 739 |
| 860 | Ac-DEYDASISQVNEKINQSLAFIRKSDELLHNVNAGK-NH2 | 740 |
| 861 | Ac-YTSLIHSLIEESQNQQEKNEQELLELDKWASLWN-NH2 | 741 |
| 862 | Ac-YTSLIHSLIEESQNQQEKNEQELLELDKWASLW-NH2 | 742 |
| 863 | Ac-YTSLIHSLIEESQNQQEKNEQELLELDKWASL-NH2 | 743 |
| 864 | Ac-YTSLIHSLIEESQNQQEKNEQELLELDKWAS-NH2 | 744 |
| 865 | Ac-QARQLLSGIVQQQNNLLRAIEAQQHLLQLTVWGIKQLQARILAVERYLKDQ-NH2 | 745 |
| 866 | Ac-DREINNYTSLIHSLIEESQNQQEKNEQELLELDKWASLWNWF-NH2 | 746 |
| 867 | Ac-NNMTWMEWDREINNYTSLIHSLIEESQNQQEKNEQELLELDK-NH2 | 747 |
| 868 | Ac-YTSLIHSLIEESQNQQEKNEQELLELDKWASLWAAA-NH2 | 748 |
| 869 | Ac-YTSLIHSLIEESQNQQEKNEQELLELDKWAAAANWF-NH2 | 749 |
| 870 | Ac-YTSLIHSLIEESQNQQEKNEQELLELDAAASLWNWF-NH2 | 750 |
| 871 | Ac-YTSLIHSLIEESQNQQEKNEQELLAAAKWASLWNWF-NH2 | 751 |
| 872 | Ac-YTSLIHSLIEESQNQQEKNEQAAAELDKWASLWNWF-NH2 | 752 |
| 873 | Ac-YTSLIHSLIEESQNQQEKAAAELLELDKWASLWNWF-NH2 | 753 |
| 874 | Ac-YTSLIHSLIEESQNQAAANEQELLELDKWASLWNWF-NH2 | 754 |
| 875 | Ac-YTSLIHSLIEESAAAQEKNEQELLELDKWASLWNWF-NH2 | 755 |
| 876 | Ac-YTSLIHSLIAAAQNQQEKNEQELLELDKWASLWNWF-NH2 | 756 |
| 877 | Ac-YTSLIHAAAEESQNQQEKNEQELLELDKWASLWNWF-NH2 | 757 |
| 878 | Ac-YTSAAASLIEESQNQQEKNEQELLELDKWASLWNWF-NH2 | 758 |
| 879 | Ac-EIWNNMTWMEWDRENEKINQSLAFIRKSDELLHNV-NH2 | 759 |
| 880 | Ac-YISEVNEEINQSLAFIRKADELLENVDKWASLWNWF-NH2 | 760 |
| 881 | Ac-TSVITIELSNIKENKANGTDAKVKLIKQELDKYKN-NH2 | 761 |
| 882 | YTSLIHSLIEESQNQQEKNEQELLELDKWASLWNWFMG-NH2 | 762 |
| 883 | Ac-NEKINQSLAFIRKSDELLHNV-NH2 | 763 |
| 884 | Biotin-YDPLVFPSDEFDASISQVNEKINQSLAFIRKSDEL-NH2 | 764 |
| 885 | Biotin-PLVFPSDEFDASISQVNEKINQSLAFIRKSDELLH-NH2 | 765 |
| 886 | Biotin-VFPSDEFDASISQVNEKINQSLAFIRKSDELLHNV-NH2 | 766 |
| 887 | Biotin-DEFDASISQVNEKINQSLAFIRKSDELLHNVNAGK-NH2 | 767 |
| 888 | Biotin-VYPSDEFDASISQVNEKINQSLAFIRKSDELLHNV-NH2 | 768 |
| 889 | Biotin-VYPSDEYDASISQVNEEINQALAYIRKADELLENV-NH2 | 769 |
| 890 | Ac-VYPSDEFDASISQVQEEIQQALAFIRKADELLEQV-NH2 | 770 |
| 891 | Ac-NYTSLIHSLIEESQNQQEKNEQELLELDKWASLWNWF-NH2 | 771 |
| 892 | Ac-NNYTSLIHSLIEESQNQQEKNEQELLELDKWASLWNWF-NH2 | 772 |
| 893 | Ac-INNYTSLIHSLIEESQNQQEKNEQELLELDKWASLWNWF-NH2 | 773 |
| 894 | Ac-EINNYTSLIHSLIEESQNQQEKNEQELLELDKWASLWNWF-NH2 | 774 |
| 895 | Ac-YTSLIHSLIEESQNQQEKNEQELLELDKWASLWNWFN-NH2 | 775 |
| 896 | Ac-YTSLIHSLIEESQNQQEKNEQELLELDKWASLWNWFNI-NH2 | 776 |

TABLE 2-continued

| T No. | Sequence | Seq. ID No. |
|---|---|---|
| 897 | Ac-YTSLIHSLIEESQNQQEKNEQELLELDKWASLWNWFNIT-NH2 | 777 |
| 898 | Ac-YTSLIHSLIEESQNQQEKNEQELLELDKWASLWNWFNITN-NH2 | 778 |
| 899 | Ac-YDPLVFPSDEFDASISQVNEKINQSLAFIRKSDELLHNVNAGK-NH2 | 779 |
| 900 | Ac-NYTSLIHSLIEESQNQQEKNEQELLELDKWASLWNWFN-NH2 | 780 |
| 901 | Ac-NNYTSLIHSLIEESQNQQEKNEQELLELDKWASLWNWFNI-NH2 | 781 |
| 905 | Ac-KCRAKFKQLLQHYREVAAAKSSENDRLRLLLKQMCPSLDVDSIIPRTPD-NH2 | 782 |
| 906 | Ac-RAKFKQLLQHYREVAAAKSSENDRLRLLLKQMCPSLDVDSIIPRTPD-NH2 | 783 |
| 907 | Ac-VYPSDEYDASISQVNEEINQALAYIAAADELLENV-NH2 | 784 |
| 909 | Ac-YDASISQVNEEINQALAYIRKADELL-NH2 | 785 |
| 910 | Ac-M-Nle-WMEWDREINNYTSLIHSLIEESQNQQEKNEQELLEL-NH2 | 1679 |
| 911 | Ac-KNGTYDYPKYEEESKLNRNEIKGVKLSSMGVYQI-NH2 | 787 |
| 912 | Ac-VTEKIQMASDNINDLIQSGVNTRLLTIQSHVQNYI-NH2 | 788 |
| 913 | QNQQEKNEQELLELDKWASLWNWF-NH2 | 789 |
| 914 | Ac-QNQQEKNEQELLELDKWASLWNWF-NH2 | 790 |
| 915 | LWNWF-NH2 | 791 |
| 916 | ELLELDKWASLWNWF-NH2 | 792 |
| 917 | EKNEQELLELDKWASLWNWF-NH2 | 793 |
| 918 | SLIEESQNQQEKNEQELLELDKWASLWNWF-NH2 | 794 |
| 919 | Ac-YTSLIHSLIEESQNQQEKNEQELLELDKWASLWNW | 795 |
| 920 | Ac-YTSLIHSLIEESQNQQEKNEQELLELDKWASLWN | 796 |
| 921 | Ac-YTSLIHSLIEESQNQQEKNEQELLELDKWASLW | 797 |
| 922 | Ac-YTSLIHSLIEESQNQQEKNEQELLELDKWASL | 798 |
| 923 | TSLIHSLIEESQNQQEKNEQELLELDKWASLWNWF-NH2 | 799 |
| 924 | SLIHSLIEESQNQQEKNEQELLELDKWASLWNWF-NH2 | 800 |
| 925 | LIHSLIEESQNQQEKNEQELLELDKWASLWNWF-NH2 | 801 |
| 926 | IHSLIEESQNQQEKNEQELLELDKWASLWNWF-NH2 | 802 |
| 940 | Ac-AAVALLPAVLLALLAPSELEIKRYKNRVASRKCRAKFKQLLQHYREVAAAK-NH2 | 803 |
| 941 | Ac-AAVALLPAVLLALLAPCRAKFKQLLQHYREVAAAKSSENDRLRLLLKQMCP-NH2 | 804 |
| 942 | Ac-YTSLIHSLIEESQNQQEKNNNIERDWEMWTMNNWIQ-NH2 | 805 |
| 944 | VYPSDEYDASISQVNEEINQALAYIRKADELLENV-NH2 | 806 |
| 945 | Ac-LMQLARQLMQLARQMKQLADSLMQLARQVSRLESA-NH2 | 807 |
| 946 | Ac-WMEWDREINNYTSLIHSLIEESQNQQEKNEQELL-NH2 | 808 |
| 947 | Ac-MEWDREINNYTSLIHSLIEESQNQQEKNEQELLEL-NH2 | 809 |
| 948 | Ac-EWDREINNYTSLIHSLIEESQNQQEKNEQELLEL-NH2 | 810 |
| 949 | Ac-MEWDREINNYTSLIHSLIEESQNQQEKNEQELLE-NH2 | 811 |
| 950 | Biotin-W-Nle-EWDREINNYTSLIHSLIEESQNQQEKNEQELLEL-NH2 | 1680 |
| 951 | Ac-YLEYDREINNYTSLIHSLIEESQNQQEKNEQELLEL-NH2 | 813 |
| 952 | Ac-IKQFINMWQEVGKAMYA-NH2 | 814 |
| 953 | Ac-IRKSDELL-NH2 | 815 |
| 954 | Decanoyl-IRKSDELL-NH2 | 815 |
| 955 | Acetyl-Aca—Aca-IRKSDELL-NH2 | 1681 |
| 956 | Ac-YDASISQV-NH2 | 816 |
| 957 | Ac-NEKINQSL-NH2 | 817 |
| 958 | Ac-SISQVNEEINQALAYIRKADELL-NH2 | 818 |
| 959 | Ac-QVNEEINQALAYIRKADELL-NH2 | 819 |
| 960 | Ac-EEINQALAYIRKADELL-NH | 820 |
| 961 | Ac-NQALAYIRKADELL-NH2 | 821 |
| 962 | Ac-LAYIRKADELL-NH2 | 822 |
| 963 | FDASISQVNEKINQALAFIRKSDELL-NH2 | 823 |
| 964 | Ac-W-Nle-EWDREINNYTSLIHSLIEESQNQQEKNEQELLEL-NH2 | 1682 |
| 965 | Ac-ASRKCRAKFKQLLQHYREVAAAKSSENDRLRLLLKQMCPSLDVDS-NH2 | 825 |
| 967 | Ac-WLEWDREINNYTSLIHSLIEESQNQQEKNEQELLEL-NH2 | 827 |
| 968 | Ac-YVKGEPIINFYDPLVFPSDEFDASISQVNEKINQSL-NH2 | 828 |
| 969 | Ac-VYPSDEYDASISQVNEEINQSLAYIRKADELLHNV-NH2 | 829 |
| 970 | Ac-YDASISQVNEEINQALAYIRKADELLENV-NH2 | 830 |
| 971 | Ac-YDASISQVNEEINQALAYIRKADELLE-NH2 | 831 |
| 972 | Ac-VYPSDEYDASISQVNEEINQALAYIRKAAELLHNV-NH2 | 832 |
| 973 | Ac-VYPSDEYDASISQVNEEINQALAYIRKALELLHNV-NH2 | 833 |
| 974 | Decanoyl-YTSLIHSLIEESQNQQEKNEQELLELDKWASLWNWF-NH2 | 834 |
| 975 | Ac-VYPSDEYDASISQVNEEINQLLAYIRKLDELLENV-NH2 | 835 |
| 976 | Ac-DEYDASISQVNEKINQSLAFIRKSDELL-NH2 | 836 |
| 977 | Ac-SNDQGSGYAADKESTQKAFDGITNKVNSVIEKTNT-NH2 | 837 |
| 978 | Ac-ESTQKAFDGITNKVNSVIEKTNTQFEAVGKEFGNLEKR-NH2 | 838 |
| 979 | Ac-DGITNKVNSVIEKTNTQFEAVGKEFGNLEKRLENLNK-NH2 | 839 |
| 980 | Ac-DSNVKNLYDKVRSQLRDNVKELGNGAFEFYHK-NH2 | 840 |
| 981 | Ac-RDNVKELGNGAFEFYHKADDEALNSVKNGTYDYPKY-NH2 | 841 |
| 982 | Ac-EFYHKADDEALNSVKNGTYDYPKY-NH2 | 842 |
| 983 | Ac-AAVALLPAVLLALLAPAADKESTQKAFDGITNKVNS-NH2 | 843 |
| 984 | Ac-AAVALLPAVLLALLAPAADSNVKNLYDKVRSQLRDN-NH2 | 844 |
| 985 | Ac-KESTQKAFDGITNKVNSV-NH2 | 845 |
| 986 | Ac-IEKTNTQFEAVGKEFGNLER-NH2 | 846 |
| 987 | Ac-RLENLNKRVEDGFLDVWTYNAELLVALENE-NH2 | 847 |
| 988 | Ac-SNVKNLYDKVRSQLRDN-NH2 | 848 |
| 989 | Ac-WMEWDREINNYTSLIHSLIEESQNQQEKNEQEL-NH2 | 849 |
| 990 | Ac-WMEWDREINNYTSLIHSLIEESQNQQEKNEQE-NH2 | 850 |
| 991 | Ac-MEWDREINNYTSLIHSLIEESQNQQEKNEQEL-NH2 | 851 |

TABLE 2-continued

| T No. | Sequence | Seq. ID No. |
|---|---|---|
| 992 | Ac-MEWDREINNYTSLIHSLIEESQNQQEKNEQE-NH2 | 852 |
| 993 | Ac-EWDREINNYTSLIHSLIEESQNQQEKNEQELLE-NH2 | 853 |
| 994 | Ac-EWDREINNYTSLIHSLIEESQNQQEKNEQELL-NH2 | 854 |
| 995 | Ac-EWDREINNYTSLIHSLIEESQNQQEKNEQEL-NH2 | 855 |
| 996 | Ac-YTKFIYTLLEESQNQQEKNEQELLELDKWASLWNWF-NH2 | 856 |
| 997 | Ac-YMKQLADSLMQLARQVSRLESA-NH2 | 857 |
| 998 | Ac-YLMQLARQMKQLADSLMQLARQVSRLESA-NH2 | 858 |
| 999 | Ac-YQEWERKVDFLEENITALLEEAQIQQEKNMYELQKL-NH2 | 859 |
| 1000 | Ac-WMAWAAAINNYTSLIHSLIEESQNQQEKNEQEEEEE-NH2 | 860 |
| 1001 | Ac-YASLIAALIEESQNQQEKNEQELLELAKWAALWAWF-NH2 | 861 |
| 1002 | [Ac-EWDREINNYTSLIHSLIEESQNQQEKNEQEGGC-NH2]dimer | 862 |
| 1003 | Ac-YDISIELNKAKSDLEESKEWIKKSNQKLDSIGNWH-NH2 | 863 |
| 1004 | Biotinyl-IDISIELNKAKSDLEESKEWIKKSNQKLDSIGNWH-NH2 | 548 |
| 1005 | Ac-YTSLI-OH | 865 |
| 1006 | Fmoc-HSLIEE-OH | 866 |
| 1007 | Fmoc-SQNQQEK-OH | 867 |
| 1008 | Fmoc-NEQELLEL-OH | 868 |
| 1009 | Fmoc-DKWASL-OH | 869 |
| 1010 | Fmoc-WNWF-OH | 870 |
| 1011 | Ac-AKTLERTWDTLNHLLFISSALYKLNLKSVAQITLSI-NH2 | 871 |
| 1012 | Ac-NITLQAKIKQFINMWQEVGKAMYA-NH2 | 872 |
| 1013 | Ac-LENERTLDFHDSNVKNLYDKVRLQLRDN-NH2 | 873 |
| 1014 | Ac-LENERTLDFHDSNVKNLYDKVRLQLRDNVKELGNG-NH2 | 874 |
| 1015 | Ac-TLDFHDSNVKNLYDKVRLQLRDNVKELGNGAFEF-NH2 | 875 |
| 1016 | Ac-IDISIELNKAKSDLEESKEWIKKSNQKLDSIGNWH-NH2 | 548 |
| 1021 | Biotinyl-SISQVNEEINQALAYIRKADELL-NH2 | 877 |
| 1022 | Biotinyl-SISQVNEEINQSLAYIRKSDELL-NH2 | 878 |
| 1023 | Ac-SISQVNEEINQSLAYIRKSDELL-NH2 | 879 |
| 1024 | Ac-IDISIELNKAKSDLEESKEWIEKSNQELDSIGNWE-NH2 | 39 |
| 1025 | Ac-IDISIELNKAKSDLEESKEWIKKSNQELDSIGNWH-NH2 | 864 |
| 1026 | Ac-IDISIELNKAKSDLEEAKEWIKKANQKLDSIGNWH-NH2 | 79 |
| 1027 | Ac-IDISIELNKAKSDLEESKEWIKKANQKLDSIGNWH-NH2 | 80 |
| 1028 | Ac-IDISIELNKAKSDLEEAKEWIKKSNQKLDSIGNWH-NH2 | 548 |
| 1029 | Biotinyl-NSVALDPIDISIELNKAKSDLEESKEWIKKSNQKL-NH2 | 880 |
| 1030 | Biotinyl-ALDPIDISIELNKAKSDLEESKEWIKKSNQKLDSI-NH2 | 881 |
| 1031 | desAminoTyrosine-NSVALDPIDISIELNKAKSDLEESKEWIKKSNQKL-NH2 | 882 |
| 1032 | desAminoTyrosine-ALDPIDISIELNKAKSDLEESKEWIKKSNQKLDSI-NH2 | 883 |
| 1033 | Ac-YDASISQVNEEINQALAFIRKADEL-NH2 | 1684 |
| 1034 | Ac-YDASISQVNEEINQSLAYIRKADELL-NH2 | 1685 |
| 1035 | Biotinyl-YDASISQVNEEINQALAYIRKADELL-NH2 | 890 |
| 1036 | Biotinyl-YDASISQVNEEINQSLAFIRKSDELL-NH2 | 885 |
| 1037 | Ac-YDASISQVNEEINQSLAFIRKSDELL-NH2 | 885 |
| 1038 | Ac-WLEWDREINNYTSLIHSLIEESQNQQEKNEQEL-NH2 | 887 |
| 1039 | Biotinyl-IDISIELNKAKSDLEESKEWIRRSNQKLDSIGNWH-NH2 | 888 |
| 1044 | Ac-YESTQKAFDGITNKVNSVIEKTNTQFEAVGKEFGNLEKR-NH2 | 81 |
| 1045 | Biotin-DEYDASISQVNEKINQSLAFIRKSDELL-NH2 | 82 |
| 1046 | Ac-MEWDREINNYTSLIHSLIEESQNQQEKNEQELL-NH2 | 571 |
| 1047 | Ac-WQEWEQKVRYLEANISQSLEQAQIQQEKNMYEL-NH2 | 892 |
| 1048 | Ac-WQEWEQKVRYLEANISQSLEQAQIQQEKNEYEL-NH2 | 893 |
| 1049 | Ac-WQEWEQKVRYLEANITALLEQAQIQQEKNEYEL-NH2 | 894 |
| 1050 | Ac-WQEWEQKVRYLEANITALLEQAQIQQEKNMYEL-NH2 | 895 |
| 1051 | Ac-WQEWEQKVRYLEANISQSLEQAQIQQEKNEYELQKL-NH2 | 896 |
| 1052 | Ac-WQEWEQKVRYLEANITALLEQAQIQQEKNEYELQKL-NH2 | 897 |
| 1053 | Ac-WQEWEQKVRYLEANITALLEQAQIQQEKNMYELQKL-NH2 | 898 |
| 1054 | Ac-IDISIELNKAKSDLEESKEWIEKSNQKLDSIGNWH-NH2 | 1686 |
| 1055 | Ac-EFGNLEKRLENLNKRVEDGFLDVWTYNAELLVALENE-NH2 | 899 |
| 1056 | Ac-EDGFLDVWTYNAELLVLMENERTLDFHDSNVKNLYDKVRMQL-NH2 | 900 |
| 1057 | Ac-SISQVNEKINQSLAFIRKSDELL-NH2 | 901 |
| 1058 | desaminoTyr-SISQVNEKINQSLAFIRKSDELL-NH2 | 902 |
| 1059 | Ac-SISQVNEKINQSLAYIRKSDELL-NH2 | 903 |
| 1060 | Ac-QQLLDVVKRQQEMLRLTVWGTKNLQARVTAIEKYLKDQ-NH2 | 904 |
| 1061 | YTSLIHSLIEESQNQQEKNEQELLELDKWASLWNWFC | 905 |
| 1062 | Ac-FDASISQVNEKINQSLAYIRKSDELL-NH2 | 906 |
| 1063 | Ac-YTSLIHSLIEESQNQQEKNEQELLELDKWA | 907 |
| 1064 | Indole-3-acetyl-DEFDASISQVNEKINQSLAFIRKSDELL-NH2 | 908 |
| 1065 | Indole-3-acetyl-DEFDESISQVNEKINQSLAFIRKSDELL-NH2 | 909 |
| 1066 | Indole-3-acetyl-DEFDESISQVNEKIEQSLAFIRKSDELL-NH2 | 910 |
| 1067 | Indole-3-acetyl-DEFDESISQVNEKIEESLAFIRKSDELL-NH2 | 911 |
| 1068 | Indole-3-acetyl-DEFDESISQVNEKIEESLQFIRKSDELL-NH2 | 912 |
| 1069 | Indole-3-acetyl-GGGGGDEFDASISQVNEKINQSLAFIRKSDELL-NH2 | 913 |
| 1070 | 2-Napthoyl-DEFDASISQVNEKINQSLAFIRKSDELL-NH2 | 914 |
| 1071 | desNH2Tyr-DEFDASISQVNEKINQSLAFIRKSDELL-NH2 | 915 |
| 1072 | biotin-ALDPIDISIELNKAKSDLEESKEWIRRSNQKLDSI-NH2 | 916 |
| 1073 | Ac-YDASISQVNEKINQALAYIRKADELLHNVAGKST-NH2 | 917 |
| 1074 | Ac-VYPSDEYDASISQVNEKINQALAYIRKADELLHNV-NH2 | 918 |
| 1075 | Ac-VYPSDEYDASISQVNEKINQSLAYIRKSDELLHNV-NH2 | 1687 |

TABLE 2-continued

| T No. | Sequence | Seq. ID No. |
|---|---|---|
| 1076 | Ac-WGWGYGYG-NH2 | 919 |
| 1077 | Ac-YGWGWGWGF-NH2 | 920 |
| 1078 | Ac-WQEWEQKVRYLEANITALQEQAQIQAEKAEYELQKL-NH2 | 921 |
| 1079 | Ac-WQEWEQKVRYLEAEITALQEEAQIQAEKAEYELQKL-NH2 | 922 |
| 1081 | Ac-YTSLIHSLIEESQNQQEKNEQELLELDKWAS | 923 |
| 1082 | Ac-VWPSDEFDASISQVNEKINQSLAFIRKSDELLHNV-NH2 | 924 |
| 1083 | Ac-SKNISEQIDQIKKDEQKEGTGWGLGGKWWTSDWGV-NH2 | 925 |
| 1084 | Ac-LSKNISEQIDQIKKDEQKEGTGWGLGGKWWTSDWG-NH2 | 926 |
| 1085 | Ac-DLSKNISEQIDQIKKDEQKEGTGWGLGGKWWTSDW-NH2 | 927 |
| 1086 | Ac-EDLSKNISEQIDQIKKDEQKEGTGWGLGGKWWTSD-NH2 | 928 |
| 1087 | Ac-IEDLSKNISEQIDQIKKDEQKEGTGWGLGGKWWTS-NH2 | 929 |
| 1088 | Ac-GIEDLSKNISEQIDQIKKDEQKEGTGWGLGGKWWT-NH2 | 930 |
| 1089 | Ac-IGIEDLSKNISEQIDQIKKDEQKEGTGWGLGGKWW-NH2 | 931 |
| 1090 | 2-Napthoyl--PSDEFDASISQVNEKINQSLAFIRKSDELLHNVN-NH2 | 932 |
| 1091 | Ac-VYPSDEYDASISQVNEKINQALAYIRKADELLENV-NH2 | 933 |
| 1092 | Ac-VYPSDEFDASISQVNEKINQALAFIRKADELLENV-NH2 | 934 |
| 1093 | Ac-VYPSDEYDASISQVNEKINQALAYIREADELLENV-NH2 | 935 |
| 1094 | Biotinyl-YDASISQVNEKINQSLAFIRESDELL-NH2 | 936 |
| 1095 | Ac-AIGIEDLSKNISEQIDQIKKDEQKEGTGWGLGGKW-NH2 | 937 |
| 1096 | Ac-AAIGIEDLSKNISEQIDQIKKDEQKEGTGWGLGGK-NH2 | 938 |
| 1097 | Ac-DAAIGIEDLSKNISEQIDQIKKDEQKEGTGWGLGG-NH2 | 939 |
| 1098 | Ac-PDAAIGIEDLSKNISEQIDQIKKDEQKEGTGWGLG-NH2 | 940 |
| 1099 | Ac-NITDKIDQIIHDFVDKTLPDQGDNDNWWTGWRQWI-NH2 | 941 |
| 1100 | Ac-KNITDKIDQIIHDFVDKTLPDQGDNDNWWTGWRQW-NH2 | 942 |
| 1101 | Ac-TKNITDKIDQIIHDFVDKTLPDQGDNDNWWTGWRQ-NH2 | 943 |
| 1102 | Ac-WTKNITDKIDQIIHDFVDKTLPDQGDNDNWWTGWR-NH2 | 944 |
| 1103 | Ac-DWTKNITDKIDQIIHDFVDKTLPDQGDNDNWWTGW-NH2 | 945 |
| 1104 | Ac-HDWTKNITDKIDQIIHDFVDKTLPDQGDNDNWWTG-NH2 | 946 |
| 1105 | Ac-PHDWTKNITDKIDQIIHDFVDKTLPDQGDNDNWWT-NH2 | 947 |
| 1106 | Ac-EPHDWTKNITDKIDQIIHDFVDKTLPDQGDNDNWW-NH2 | 948 |
| 1107 | Ac-IEPHDWTKNITDKIDQIIHDFVDKTLPDQGDNDNW-NH2 | 949 |
| 1108 | Ac-AIEPHDWTKNITDKIDQIIHDFVDKTLPDQGDNDN-NH2 | 950 |
| 1109 | Ac-AAIEPHDWTKNITDKIDQIIHDFVDKTLPDQGDND-NH2 | 951 |
| 1110 | Ac-DAAIEPHDWTKNITDKIDQIIHDFVDKTLPDQGDN-NH2 | 952 |
| 1111 | Ac-LSPTVWLSVIWMMWYWGPSLYSILSPFLPLLPIFF-NH2 | 953 |
| 1112 | Ac-GLSPTVWLSVIWMMWYWGPSLYSILSPFLPLLPIF-NH2 | 1345 |
| 1113 | Ac-VGLSPTVWLSVIWMMWYWGPSLYSILSPFLPLLPI-NH2 | 1346 |
| 1114 | Ac-FVGLSPTVWLSVIWMMWYWGPSLYSILSPFLPLLP-NH2 | 1347 |
| 1115 | Ac-WFVGLSPTVWLSVIWMMWYWGPSLYSILSPFLPLL-NH2 | 1348 |
| 1116 | Ac-QWFVFLSPTVWLSVIWMMWYWGPSLYSILSPFLPL-NH2 | 1688 |
| 1117 | Ac-VQWFVGLSPTVWLSVIWMMWYWGPSLYSILSPFLP-NH2 | 1350 |
| 1118 | Ac-FVQWFVGLSPTVWLSVIWMMWYWGPSLYSILSPFL-NH2 | 1351 |
| 1119 | Ac-PFVQWFVGLSPTVWLSVIWMMWYWGPSLYSILSPF-NH2 | 1352 |
| 1120 | Ac-VPFVQWFVGLSPTVWLSVIWMMWYWGPSLYSILSP-NH2 | 1353 |
| 1121 | Ac-LVPFVQWFVGLSPTVWLSVIWMMWYWGPSLYSILS-NH2 | 1354 |
| 1122 | H-NHTTWMEWDREINNYTSLIHSLIEESQNQQEKNEQELLELDKW-OH | 954 |
| 1123 | H-QARQLLSGIVQQQNNLLRAIEAQQHLLQLTVWGIKQLQARILAVERYLKDQ-OH | 955 |
| 1124 | Ac-VYPSDEFDASISQVNEKINQSLAFIREADELLENV-NH2 | 956 |
| 1125 | Ac-VFPSDEFDASISQVNEKINQSLAYIREADELLENV-NH2 | 957 |
| 1126 | Ac-DEFDASISQVNEKINQSLAYIREADELL-NH2 | 958 |
| 1127 | Ac-NEQELLELDKWASLWNWFGGGGDEFDASISQVNEKINQSLAFIRKSDELL-NH2 | 959 |
| 1128 | Ac-LELDKWASLWNWFGGGGDEFDASISQVNEKINQSLAFIRKSDELL-NH2 | 960 |
| 1129 | Naphthoyl-EGEGEGEGDEFDASISQVNEKINQSLAFIRKSDELL-NH2 | 961 |
| 1130 | Ac-ASRKCRAKFKQLLQHYREVAAAKSSENDRLRLLLKQMCPSLDV-NH2 | 962 |
| 1131 | Naphthoyl-GDEEDASISQVNEKINQSLAFIRKSDELL-NH2 | 963 |
| 1132 | Naphthoyl-GDEEDASESQVNEKINQSLAFIRKSDELL-NH2 | 964 |
| 1133 | Naphthoyl-GDEEDASESQQNEKINQSLAFIRKSDELL-NH2 | 965 |
| 1134 | Naphthoyl-GDEEDASESQQNEKQNQSLAFIRKSDELL-NH2 | 966 |
| 1135 | Naphthoyl-GDEEDASESQQNEKQNQSEAFIRKSDELL-NH2 | 967 |
| 1136 | Ac-WGDEFDESISQVNEKIEESLAFIRKSDELL-NH2 | 968 |
| 1137 | Ac-YTSLGGDEFDESISQVNEKIEESLAFIRKSDELLGGWNWF-NH2 | 969 |
| 1138 | Ac-YTSLIHSLGGDEFDESISQVNEKIEESLAFIRKSDELLGGWASLWNWF-NH | 970 |
| 1139 | 2-Naphthoyl-GDEFDESISQVNEKIEESLAFIRKSDELL-NH2 | 971 |
| 1140 | 2-Naphthoyl-GDEEDESISQVNEKIEESLAFIRKSDELL-NH2 | 972 |
| 1141 | 2-Naphthoyl-GDEEDESISQVQEKIEESLAFIRKSDELL-NH2 | 973 |
| 1142 | 2-Naphthoyl-GDEEDESISQVQEKIEESLLFIRKSDELL-NH2 | 974 |
| 1143 | Biotin-GDEYDESISQVNEKIEESLAFIRKSDELL-NH2 | 975 |
| 1144 | 2-Naphthoyl-GDEYDESISQVNEKIEESLAFIRKSDELL-NH2 | 976 |
| 1145 | Ac-YTSLIHSLIDEQEKIEELAFIRKSDELLELDKWNWF-NH2 | 977 |
| 1146 | VYPSDEYDASISQVNEEINQALAYIRKADELLENV-NH2 | 978 |
| 1147 | Ac-NNLLRAIEAQQHLLQLTVWGSKQLQARILAVERYLKDQ-NH2 | 979 |
| 1148 | GGGVYPSDEYDASISQVNEEINQALAYIRKADELLENV-NH2 | 980 |
| 1149 | Ac-NNLLRAIEAQQHLLQLTVWGEKQLQARILAVERYLKDQ-NH2 | 981 |
| 1150 | Ac-PTRVNYILIIGVLVLAbuEVTGVRADVHLL-NH2 | 1689 |
| 1151 | Ac-PTRVNYILIIGVLVLAbuEVTGVRADVHLLEQPGNLW-NH2 | 1690 |
| 1152 | Ac-PEKTPLLPTRVNYILIIGVLVLAbuEVTGVRADVHLL-NH2 | 1691 |

TABLE 2-continued

| T No. | Sequence | Seq. ID No. |
|---|---|---|
| 1153 | AhaGGGVYPSDEYDASISQVNEEINQALAYIRKADELLENV-NH2 | 1692 |
| 1155 | Ac-YTSLIHSLGGDEFDESISQVNEKIEESLAFIRKSDELL-NH2 | 986 |
| 1156 | Ac-YTSLGGDEFDESISQVNEKIEESLAFIRKSDELL-NH2 | 987 |
| 1157 | Ac-DEFDESISQVNEKIEESLAFIRKSDELLGGWASLWNWF-NH2 | 988 |
| 1158 | Ac-DEFDESISQVNEKIEESLAFIRKSDELLGGWNWF-NH2 | 989 |
| 1159 | Ac-YTSLIHSLIEESQNQQEKNEQELLELDKASLWNWF-NH2 | 990 |
| 1160 | Ac-YTSLIHSLIEESQNQQEKNEQELLELDKSLWNWF-NH2 | 991 |
| 1161 | Ac-YTSLIHSLIEESQNQQEKNEQELLELDKLWNWF-NH2 | 992 |
| 1162 | Ac-YTSLIHSLIEESQNQQEKNEQELLELDKWNWF-NH2 | 993 |
| 1163 | Ac-MTWMEWDREINNYTSLIHSLIEESQNQQEKNEQELLELDKASLWNWF-NH2 | 994 |
| 1164 | Ac-MTWMEWDREINNYTSLIHSLIEESQNQQEKNEQELLELDKSLWNWF-NH2 | 995 |
| 1165 | Ac-MTWMEWDREINNYTSLIHSLIEESQNQQEKNEQELLELDKLWNWF-NH2 | 996 |
| 1166 | Ac-MTWMEWDREINNYTSLIHSLIEESQNQQEKNEQELLELDKWNWF-NH2 | 997 |
| 1167 | Ac-MTWMEWDREINNYTSLIHSLIEESQNQQEKNEQELLELDKWASLWN-NH2 | 998 |
| 1168 | Ac-MTWMEWDREINNYTSLIHSLIEESQNQQEKNEQELLELDKWASL-NH2 | 999 |
| 1169 | (Pyr)HWSY(2-napthyl-D-Ala)LRPG-NH2 | 1693 |
| 1170 | Ac-WNWFDEFDESISQVNEKIEESLAFIRKSDELLWNWF-NH2 | 1001 |
| 1171 | Ac-YTSLIHSLIEESQNQQEKNEQELLELDKYASLYNYF-NH2 | 1002 |
| 1172 | Ac-YTSLIHSLIEESQNQQEKNEQELLELDKYAYLYNYF-NH2 | 1003 |
| 1173 | 2-Naphthoyl-AcaAcaAcaDEFDESISQVNEKIEESLAFIRKSDELLAcaAcaAcaW-NH2 | 1694 |
| 1174 | 2-Naphthoyl-AcaAcaAcaGDEFDESISQVNEKIEESLAFIRKSDELLGAcaAcaAcaW-NH2 | 1695 |
| 1175 | 2-Naphthoyl-GDEFDESISQVNEKIEESLAFIRESDELL-NH2 | 1006 |
| 1176 | 2-Naphthoyl-GDEFDESISQVNEKIEESLAFIEESDELL-NH2 | 1007 |
| 1177 | Ac-WQEWEQKVNYLEANITALLEQAQIQQEKNEYELQKL-NH2 | 1008 |
| 1178 | Ac-WQEWEQKVDYLEANITALLEQAQIQQEKNEYELQKL-NH2 | 1009 |
| 1179 | Ac-WQEWEQKVRWLEANITALLEQAQIQQEKNEYELQKL-NH2 | 1010 |
| 1180 | Ac-WQEWEKQVRYLEANITALLEQAQIQQEKNEYELQKL-NH2 | 1011 |
| 1181 | Ac-WQEWEHQVRYLEANITALLEQAQIQQEKNEYELQKL-NH2 | 1012 |
| 1182 | Ac-WQEWEHKVRYLEANITALLEQAQIQQEKNEYELQKL-NH2 | 1013 |
| 1183 | Ac-WQEWDREVRYLEANITALLEQAQIQQEKNEYELQKL-NH2 | 1014 |
| 1184 | Ac-WQEWEREVRYLEANITALLEQAQIQQEKNEYELQKL-NH2 | 1015 |
| 1185 | Ac-WQEWERQVRYLEANITALLEQAQIQQEKNEYELQKL-NH2 | 1016 |
| 1186 | Ac-WQEWEQKVKYLEANITALLEQAQIQQEKNEYELQKL-NH2 | 1017 |
| 1187 | Ac-WQEWEQKVRFLEANITALLEQAQIQQEKNEYELQKL-NH2 | 1018 |
| 1188 | Ac-VNalPSDEYDASISQVNEEINQALAYIRKADELLENV-NH2 | 1696 |
| 1189 | Ac-VNalPSDENalDASISQVNEEINQALAYIRKADELLENV-NH2 | 1697 |
| 1190 | Ac-VNalPSDEYDASISQVNEEINQALANalIRKADELLENV-NH2 | 1698 |
| 1191 | Ac-VYPSDEFDASISQVNEKINQSLAFIREADELLFNFF-NH2 | 1022 |
| 1192 | Ac-VYPSDEYDASISQVNEEINQALAYIRKADELLFNFF-NH2 | 1023 |
| 1193 | Ac-YTSLITALLEQAQIQQEKNEYELQKLDKWASLWNWF-NH2 | 1024 |
| 1194 | Ac-YTSLITALLEQAQIQQEKNEYELQKLDKWASLWEWF-NH2 | 1699 |
| 1195 | Ac-YTSLITALLEQAQIQQEKNEYELQKLDEWASLWEWF-NH2 | 1026 |
| 1196 | Ac-YTSLITALLEQAQIQQEKNEYELQELDEWASLWEWF-NH2 | 1027 |
| 1197 | Ac-YTSLITALLEEAQIQQEKNEYELQELDEWASLWEWF-NH2 | 1028 |
| 1198 | Naphthoyl-Aua—Aua—Aua-TALLEQAQIQQEKNEYELQKLAua—Aua—Aua-W-NH2 | 1700 |
| 1199 | Ac-WAAWEQKVRYLEANITALLEQAQIQQEKNEYELQKL-NH2 | 1030 |
| 1200 | Ac-WQEAAQKVRYLEANITALLEQAQIQQEKNEYELQKL-NH2 | 1031 |
| 1201 | Ac-WQEWAAKVRYLEANITALLEQAQIQQEKNEYELQKL-NH2 | 1032 |
| 1202 | Ac-WQAAEQKVRYLEANITALLEQAQIQQEKNEYELQKL-NH2 | 1701 |
| 1203 | Ac-WQEWEAAVRYLEANITALLEQAQIQQEKNEYELQKL-NH2 | 1702 |
| 1204 | Ac-WQEWEQAARYLEANITALLEQAQIQQEKNEYELQKL-NH2 | 1703 |
| 1205 | Ac-WQEWEQKAAYLEANITALLEQAQIQQEKNEYELQKL-NH2 | 1704 |
| 1206 | Ac-WQEWEQKVAALEANITALLEQAQIQQEKNEYELQKL-NH2 | 1705 |
| 1207 | Ac-WQEWEQKVRYLEANITALLEQAQIQQEKNEYELQKLGGGGWASLWNF-NH2 | 1706 |
| 1208 | 2-Naphthoyl-GDEFDASISQVNEKINQSLAFIRKSDELT-NH2 | 1039 |
| 1209 | 2-Naphthoyl-GDEFDASISQVNEKINQSLAFTRKSDELT-NH2 | 1040 |
| 1210 | 2-Naphthoyl-GDEFDASISQVNEKTNQSLAFTRKSDELT-NH2 | 1037 |
| 1211 | 2-Naphthoyl-GDEFDASISQTNEKTNQSLAFTRKSDELT-NH2 | 1038 |
| 1212 | 2-Naphthoyl-GDEFDASTSQTNEKTNQSLAFTRKSDELT-NH2 | 1039 |
| 1213 | 2-Naphthoyl-GDEYDASTSQTNEKTNQSLAFTRKSDELT-NH2 | 1040 |
| 1214 | 2-Naphthoyl-GDEFDEEISQVNEKIEESLAFIRKSDELL-NH2 | 1041 |
| 1215 | 2-Naphthoyl-GDEFDASISQVNEKINQSLAFIRKSDELA-NH2 | 1042 |
| 1216 | 2-Naphthoyl-GDEFDASASQANEKANQSLAFARKSDELA-NH2 | 1043 |
| 1217 | 2-Naphthoyl-GDEFDESISQVNEKIEESLAFTRKSDELL-NH2 | 1044 |
| 1218 | 2-Naphthoyl-GDEFDESISQVNEKTEESLAFIRKSDELL-NH2 | 1045 |
| 1219 | 2-Naphthoyl-GDEFDESISQTNEKIEESLAFIRKSDELL-NH2 | 1046 |
| 1220 | 2-Naphthoyl-GDEFDESTSQVNEKIEESLAFIRKSDELL-NH2 | 1047 |
| 1221 | Ac-WNWFDEFDESTSQVNEKIEESLAFIRKSDELLWNWF-NH2 | 1048 |
| 1222 | Ac-WNWFDEFDESTSQTNEKIEESLAFIRKSDELLWNWF-NH2 | 1049 |
| 1223 | Ac-WNWFDEFDESTSQTNEKTEESLAFIRKSDELLWNWF-NH2 | 1050 |
| 1224 | Ac-LQAGFFLLTRILTIPQSLDSWWTSLNFLGGTTVAL-NH2 | 1355 |
| 1225 | Ac-YTNLIYTLLEESQNQQEKNEQELLELDKWASLWSWF-NH2 | 1051 |
| 1226 | Ac-WQEWEQKVRYLEANITALLEQAQIQQEKNEYELQKLDKWASLWNWF-NH2 | 1052 |
| 1227 | Ac-NNMTWQEWEQKVRYLEANITALLEQAQIQQEKNEYELQKLDKWASLWNWF-NH2 | 1053 |
| 1230 | Ac-WNWFIEESDELLWNWF-NH2 | 1054 |
| 1231 | 2-Naphthoyl-GFIEESDELLW-NH2 | 1055 |

TABLE 2-continued

| T No. | Sequence | Seq. ID No. |
|---|---|---|
| 1232 | Ac-WFIEESDELLW-NH2 | 1056 |
| 1233 | 2-Naphthoyl-GFNFFIEESDELLFNFF-NH2 | 1057 |
| 1234 | 2-Naphthoyl-GESDELW-NH2 | 1058 |
| 1235 | Ac-WNWFGDEFDESISQVQEEIEESLAFIEESDELLGGWNWF-NH2 | 1059 |
| 1236 | Ac-WNWFIHSLIEESQNQQEKNEQELLELDKWASLWNWF-NH2 | 1356 |
| 1237 | Ac-YTSLITALLEQAQIQQEENEYELQALDEWASLWEWF-NH2 | 1025 |
| 1238 | Ac-YTSLIHSLGGDEFDESISQVNEEIEESLAFIEESDELLGGWASLWNWF-NH2 | 1060 |
| 1239 | 2-Naphthoyl-GDEFDESISQVQEEIEESLAFIEESDELL-NH2 | 1061 |
| 1240 | H-QARQLLSSIMQQQNNLLRAIEAQQHLLQLTVWGIKQLQARILAVERYLKDQ-OH | 1062 |
| 1241 | Ac-CPKYVKQNTLKLATGMRNVPEKQTR-NH2 | 1063 |
| 1242 | Ac-GLFGAIAGFIENGWEGMIDGWYGFRHQNSC-NH2 | 1064 |
| 1243 | Ac-LNFLGGT-NH2 | 1065 |
| 1244 | Ac-LDSWWTSLNFLGGT-NH2 | 1066 |
| 1245 | Ac-ILTIPQSLDSWWTSLNFLGGT-NH2 | 1067 |
| 1246 | Ac-GFFLLTRILTIPQSLDSWWTSLNFLGGT-NH2 | 1068 |
| 1247 | Ac-WQEWEQKITALLEQAQIQQEKNEYELQKLDKWASLWNWF-NH2 | 1069 |
| 1248 | Ac-WNWFITALLEQAQIQQEKNEYELQKLDKWASLWNWF-NH2 | 1070 |
| 1249 | Ac-WQEWEQKITALLEQAQIQQEKNEYELQKLDKWASLWEWF-NH2 | 1071 |
| 1250 | Ac-WQEWEQKVRYLEANITALLEQAQIQQEKIEYELQKL-NH2 | 1072 |
| 1251 | Ac-WQEWEQKVRYLEAQITALLEQAQIQQEKIEYELQKL-NH2 | 1073 |
| 1252 | Ac-KENKANGTDAKVKLIKQELDKYKNAVTELQLLMQS-NH2 | 1074 |
| 1253 | Ac-NIKENKANGTDAKVKLIKQELDKYKNAVTELQLLM-NH2 | 1075 |
| 1254 | (FS)-YTSLIHSLIEESQNQQEKNEQELLELDKWASLWNWF-NH2 | 1076 |
| 1255 | 2-Naphthoyl-GWNWFAcaDEFDESISQVQEEIEESLAFIEESDELLAcaWNWF-NH2 | 1707 |
| 1256 | Ac-WNWFGDEFDESISQVNEKIEESLAFIEESDELLGWNWF-NH2 | 1078 |
| 1257 | Ac-WNWFGDEFDESISQVNEKIEESLAFIRKSDELLGWNWF-NH2 | 1079 |
| 1258 | Ac-WNWF-Aca-DEFDESISQVNEKIEESLAFIRKSDELL-Aca-WNWF-NH2 | 1708 |
| 1259 | Ac-WNWF-Aca-DEFDESISQVNEKIEESLAFIEESDELL-Aca-WNWF-NH2 | 1709 |
| 1260 | Ac-EESQNQQEKNEQELLELDKWA-NH2 | 1082 |
| 1261 | EESQNQQEKNEQELLELDKWA | 1083 |
| 1262 | Ac-CGTTDRSGAPTYSWGANDTDVFVLNNTRPPLGNWFG-NH2 | 1084 |
| 1263 | Ac-GVEHRLEAACNWTRGERADLEDRDRSELSP-NH2 | 1085 |
| 1264 | Ac-CVREGNASRAWVAVTPTVATRDGKLPT-NH2 | 1086 |
| 1265 | Ac-CFSPRHHWTTQDANASIYPG-NH2 | 1087 |
| 1266 | Ac-LQHYREVAAAKSSENDRLRLLLKQMCPSLDVDS-NH2 | 1088 |
| 1267 | Ac-WQEWDREISNYTSLITALLEQAQIQQEKNEYELQKLDEWASLWEWF-NH2 | 1089 |
| 1268 | Ac-CWQEWDREISNYTSLITALLEQAQIQQEKNEYELQKLDEWASLWEWFC-NH2 | 1090 |
| 1269 | Ac-WQEWDREISNYTSLITALLEQAQIQQEKNEYELQKLDEWEWF-NH2 | 1091 |
| 1270 | Ac-CWQEWDREISNYTSLITALLEQAQIQQEKNEYELQKLDEWEWFC-NH2 | 1092 |
| 1271 | Ac-GQNSQSPTSNHSPTSAPPTAPGYRWA-NH2 | 1093 |
| 1272 | Ac-PGSSTTSTGPARTALTTAQGTSLYPSA-NH2 | 1094 |
| 1273 | Ac-PGSSTTSTGPARTALTTAQGTSLYPSAAATKPSDGNATA-NH2 | 1095 |
| 1275 | Ac-WQEWDREITALLEQAQIQQEKNEYELQKLDKWASLWNWF-NH2 | 1097 |
| 1276 | Ac-WQEWDREITALLEQAQIQQEKNEYELQKLDEWASLWEWF-NH2 | 1098 |
| 1277 | Ac-WQEWDREITALLEQAQIQQEKNEYELQKLDEWEWF-NH2 | 1099 |
| 1278 | Ac-WQEWEREITALLEQAQIQQEKNEYELQKLDEWEWF-NH2 | 1100 |
| 1279 | Ac-WQEWEREITALLEQAQIQQEKNEYELQKLIEWEWF-NH2 | 1101 |
| 1280 | Ac-WQEWEREITALLEQAQIQQEKIEYELQKLDEWEWF-NH2 | 1102 |
| 1281 | Ac-WQEWEITALLEQAQIQQEKNEYELQKLDEWEWF-NH2 | 1103 |
| 1282 | Ac-WQEWEITALLEQAQIQQEKNEYELQKLIEWEWF-NH2 | 1104 |
| 1283 | Ac-WQEWEITALLEQAQIQQEKIEYELQKLDEWEWF-NH2 | 1105 |
| 1284 | Ac-WQEWEITALLEQAQIQQEKIEYELQKLIEWEWF-NH2 | 1106 |
| 1285 | Ac-WQEWDREIDEYDASISQVNEKINQALAYIREADELWEWF-NH2 | 1107 |
| 1286 | Ac-WQEWEREIDEYDASISQVNEKINQALAYIREADELWEWF-NH2 | 1108 |
| 1287 | Ac-WQEWEIDEYDASISQVNEKINQALAYIREADELWEWF-NH2 | 1109 |
| 1288 | Ac-WQEWDREIDEYDASISQVNEEINQALAYIREADELWEWF-NH2 | 1110 |
| 1289 | Ac-WQEWEREIDEYDASISQVNEEINQALAYIREADELWEWF-NH2 | 1111 |
| 1290 | Ac-WQEWEIDEYDASISQVNEEINQALAYIREADELWEWF-NH2 | 1112 |
| 1291 | Ac-WQEWDEYDASISQVNEKINQALAYIREADELWEWF-NH2 | 1113 |
| 1292 | Ac-WQEWDEYDASISQVNEEINQALAYIREADELWEWF-NH2 | 1114 |
| 1293 | Ac-WQEWEQKITALLEQAQIQQEKIEYELQKLIEWEWF-NH2 | 1115 |
| 1294 | Ac-WQEWEQKITALLEQAQIQQEKIEYELQKLIEWASLWEWF-NH2 | 1116 |
| 1295 | Ac-WQEWEITALLEQAQIQQEKIEYELQKLIEWASLWEWF-NH2 | 1117 |
| 1298 | -VYPSDEYDASISQVNEEINQALAYIRKADELLENV-NH2 | 1160 |
| 1299 | Ac-WVYPSDEYDASISQVNEEINQALAYIRKADELLENVWNWF-NH2 | 1120 |
| 1300 | YTSLIHSLIEESQNQQEKNEQELLELDKWASLWNWF-NH2 | 1121 |
| 1301 | Ac-WQEWDEYDASISQVNEKINQALAYIREADELWAWF-NH2 | 1122 |
| 1302 | Ac-WQAWDEYDASISQVNEKINQALAYIREADELWAWF-NH2 | 1123 |
| 1303 | Ac-WQAWDEYDASISQVNEKINQALAYIREADELWEWF-NH2 | 1124 |
| 1304 | Biotin-YDPLVFPSDEFDASISQVNEKINQSLAFIRKSDEL-NH2 | 1125 |
| 1305 | Biotin-YDPLVFPSDEFDASISQVNEKINQSLAF-NH2 | 1126 |
| 1306 | Biotin-QVNEKINQSLAFIRKSDELLHNVNAGKST-NH2 | 1127 |
| 1307 | Ac-WMEWDREI-NH2 | 1128 |
| 1308 | Ac-WQEWEQKI-NH2 | 1129 |
| 1309 | Ac-WQEWEQKITALLEQAQIQQEKIEYELQKLIKWASLWEWF-NH2 | 1130 |
| 1310 | Ac-WQEWEQKITALLEQAQIQQEKIEYELQKLIEWASLWEWF-NH2 | 1131 |

TABLE 2-continued

| T No. | Sequence | Seq. ID No. |
|---|---|---|
| 1311 | Ac-WQEWEREISAYTSLITALLEQAQIQQEKIEYELQKLIEWEWF-NH2 | 1132 |
| 1312 | Ac-WQEWEREISAYTSLITALLEQAQIQQEKIEYELQKEWEWF-NH2 | 1133 |
| 1313 | Ac-WQEWEREISAYTSLITALLEQAQIQQEKIEYELQKEWEW-NH2 | 1134 |
| 1314 | Ac-WQEWEREISAYTSLITALLEQAQIQQEKIEYELQKLIEWEW-NH2 | 1135 |
| 1315 | Ac-FNLSDHSESIQKKFQLMKKHVNKIGVDSDPIGSWLR-NH2 | 1136 |
| 1316 | Ac-DHSESIQKKFQLMKKHVNKIGVDSDPIGSWLRGIF-NH2 | 1137 |
| 1317 | Ac-WSVKQANLTTSLLGDLLDDVTSIRHAVLQNRA-NH2 | 1138 |
| 1318 | Biotin-WMEWDREI-NH2 | 1128 |
| 1319 | Biotin-NNMTWMEWDREINNYTSL-NH2 | 1139 |
| 1320 | Ac-GAASLTLTVQARQLLSGIVQQQNNLLRAIEAQQHLL-NH2 | 1140 |
| 1321 | Ac-ASLTLTVQARQLLSGIVQQQNNLLRAIEAQQHLLQL-NH2 | 1141 |
| 1322 | Ac-VSVGNTLYYVNKQEGKSLYVKGEPIINFYDPLVF-NH2 | 1142 |
| 1323 | Ac-QHWSYGLRPG-NH2 | 1143 |
| 1324 | Ac-WQEWEQKIQHWSYGLRPGWASLWEWF-NH2 | 1144 |
| 1325 | Ac-WQEWEQKIQHWSYGLRPGWEWF-NH2 | 1145 |
| 1326 | Ac-WNWFQHWSYGLRPGWNWF-NH2 | 1146 |
| 1327 | Ac-FNFFQHWSYGLRPGFNFF-NH2 | 1147 |
| 1328 | Ac-GAGAQHWSYGLRPGAGAG-NH2 | 1148 |
| 1329 | PLLVLQAGFFLLTRILTIPQSLDSWWTSLNFLGGT | 482 |
| 1330 | Ac-WQEWEQKITALLEQAQIQQEKIEYELQKLAKWASLWEWF-NH2 | 1149 |
| 1331 | Ac-WQEWEQKITALLEQAQIQQEKIEYELQKLAEWASLWEWF-NH2 | 1150 |
| 1332 | Ac-WQEWEQKITALLEQAQIQQEKAEYELQKLAEWASLWEWF-NH2 | 1151 |
| 1333 | Ac-WQEWEQKITALLEQAQIQQEKAEYELQKLAEWASLWAWF-NH2 | 1152 |
| 1334 | Ac-WQEWEQKITALLEQAQIQQEKAEYELQKLAKWASLWAWF-NH2 | 1153 |
| 1335 | Ac-TNKAVVSLSNGVSVLTSKVLDLKNYIDKQLLPIVNK-NH2 | 1154 |
| 1336 | Ac-KAVVSLSNGVSVLTSKVLDLKNYIDKQLLPIVNKQS-NH2 | 1155 |
| 1337 | Ac-WQEWEQKITALLEQAQIQQEKNEYELQKLIEWEWF-NH2 | 1156 |
| 1338 | Ac-WQEWEQKITALLEQAQIQQEKGEYELQKLIEWEWF-NH2 | 1157 |
| 1339 | Ac-WQEWEQKITALLEQAQIQQEKIEYELQKLDKWEWF-NH2 | 1158 |
| 1340 | Ac-YDPLVFPSDEFDASISQVNEKINQSLAF-NH2 | 1159 |
| 1341 | Fluor--VYPSDEYDASISQVNEEINQALAYIRKADELLENV-NH2 | 1160 |
| 1342 | Fluor-YTSLIHSLIEESQNQQEKNEQELLELDKWASLWNWF-NH2 | 1161 |
| 1344 | Ac-SGIVQQQNNLLRAIEAQQHLLQLTVWGIKQLQARIL-NH2 | 1162 |
| 1345 | Ac-QQQNNLLRAIEAQQHLLQLTVWGIKQLQARILAVERYLKDQ-NH2 | 1163 |
| 1346 | Ac-SGIVQQQNNLLRAIEAQQHLLQLTVWGIKQLQARILAVERYLKDQ-NH2 | 1164 |
| 1347 | Ac-WQEWEQKITALLEQAQIQQEKNEYELQKLAEWASLWAWF-NH2 | 1165 |
| 1348 | Ac-WQEWEQKITALLEQAQIQQEKNEYELQKLAEWASLWAW-NH2 | 1166 |
| 1349 | Ac-WQEWEQKITALLEQAQIQQEKAEYELQKLAEWASLWAW-NH2 | 1167 |
| 1350 | Ac-WQEWEQKITALLEQAQIQQEKNEYELQKLAEWAGLWAWF-NH2 | 1168 |
| 1351 | Ac-WQEWEQKITALLEQAQIQQEKNEYELQKLAEWAGLWAW-NH2 | 1169 |
| 1352 | Ac-WQEWEQKITALLEQAQIQQEKAEYELQKLAEWAGLWAW-NH2 | 1170 |
| 1353 | Ac-WQEWEQKITALLEQAQIQQEKNEYELQKLDKWAGLWEWF-NH2 | 1171 |
| 1354 | Ac-WQEWQHWSYGLRPGWEWF-NH2 | 1172 |
| 1355 | Ac-WQAWQHWSYGLRPGWAWF-NH2 | 1173 |
| 1356 | Biotinyl-WQEWEQKITALLEQAQIQQEKNEYELQKLDKWASLWEWF-NH2 | 1174 |
| 1357 | WQEWEQKITALLEQAQIQQEKNEYELQKLDKWASLWEWF | 1175 |
| 1358 | WQEWEQKITALLEQAQIQQEKIEYELQKLIEWEWF | 1176 |
| 1361 | Ac-AGSTMGARSMTLTVQARQLLSGIVQQQNNLLRAIEAQQ-NH2 | 1179 |
| 1362 | Ac-AGSAMGAASLTLSAQSRTLLAGIVQQQQQLLDVVKRQQ-NH2 | 1180 |
| 1363 | Ac-AGSAMGAASTALTAQSRTLLAGIVQQQQQLLDVVKRQQ-NH2 | 1181 |
| 1364 | Ac-ALTAQSRTLLAGIVQQQQQLLDVVKRQQELLRLTVWGT-NH2 | 1182 |
| 1365 | Ac-TLSAQSRTLLAGIVQQQQQLLDVVKRQQEMLRLTVWGT-NH2 | 1183 |
| 1366 | Ac-TLTVQARQLLSGIVQQQNNLLRAIEAQQHLLQLTVWGI-NH2 | 1184 |
| 1367 | Ac-WQAWIEYEAELSQVKEKIEQSLAYIREADELWAWF-NH2 | 1185 |
| 1368 | Ac-WQAWIEYEASLSQAKEKIEESKAYIREADELWAWF-NH2 | 1186 |
| 1369 | Ac-WQAWIEYERLLVQAKLKIAIAKLYIAKELLEWAWF-NH2 | 1187 |
| 1370 | Ac-WQAWIEYERLLVQVKLKIAIALLYIAKELLEWAWF-NH2 | 1188 |
| 1371 | Ac-WQAWIELERLLVQVKLKLAIAKLEIAKELLEWAWF-NH2 | 1189 |
| 1372 | Ac-GEWTYDDATKTFTVTEGGH-NH2 | 1190 |
| 1373 | Ac-WQEWEQKIGEWTYDDATKTFTVTEGGHWASLWEWF-NH2 | 1191 |
| 1374 | Ac-GEWTYDDATKTFTVTE-NH2 | 1192 |
| 1375 | Ac-WQEWEQKIGEWTYDDATKTFTVTEWASLWEWF-NH2 | 1193 |
| 1376 | Ac-MHRFDYRT-NH2 | 1194 |
| 1377 | Ac-WQEWEQKIMHRFDYRTWASLWEWF-NH2 | 1195 |
| 1378 | Ac-MHRFNWSTGGG-NH2 | 1196 |
| 1379 | Ac-WQEWEQKIMHRFNWSTGGGWASLWEWF-NH2 | 1197 |
| 1380 | Ac-MHRFNWST-NH2 | 1198 |
| 1381 | Ac-WQEWEQKIMHRFNWSTWASLWEWF-NH2 | 1199 |
| 1382 | Ac-LLVPLARIMTMSSVHGGG-NH2 | 1200 |
| 1383 | Ac-WQEWEQKILLVPLARIMTMSSVHGGGWASLWEWF-NH2 | 1201 |
| 1384 | Ac-LLVPLARIMTMSSVH-NH2 | 1202 |
| 1385 | Ac-WQEWEQKILLVPLARIMTMSSVHWASLWEWF-NH2 | 1203 |
| 1386 | TALLEQAQIQQEKNEYELQKLDK | 1204 |
| 1387 | Ac-TALLEQAQIQQEKNEYELQKLDK-NH2 | 1205 |
| 1388 | Ac-TALLEQAQIQQEKIEYELQKLIE-NH2 | 1206 |
| 1389 | TALLEQAQIQQEKIEYELQKLIE | 1207 |

TABLE 2-continued

| T No. | Sequence | Seq. ID No. |
|---|---|---|
| 1390 | Ac-QARQLLSGIVQQQNNLLRAIEAQQHLLQLTVWGIKQLQARILAVERY-NH2 | 1208 |
| 1391 | Rhod-QARQLLSGIVQQQNNLLRAIEAQQHLLQLTVWGIKQLQARILAVERY-NH2 | 1209 |
| 1392 | Ac-GAASLTLSAQSRTLLAGIVQQQQQLLDVVKRQQEML-NH2 | 1210 |
| 1393 | Ac-GSAMGAASLTLSAQSRTLLAGIVQQQQQLLDVVKRQQEML-NH2 | 1211 |
| 1394 | Ac-PALSTGLIHLHQNIVDVQFLFGVGSSIASWAIKWEY-NH2 | 1212 |
| 1395 | Ac-PALSTGLIHLHQNIVDVQFLYGVGSSIASWAIK-NH2 | 1213 |
| 1396 | Ac-LSTTQWQVLPUSFTTLPALSTGLIHLHQNIVDVQY-NH2 | 1712 |
| 1397 | Ac-FRKFPEATFSRUGSGPRITPRUMVDFPFRLWHY-NH2 | 1713 |
| 1398 | Ac-DFPFRLWHFPUTINYTIFKVRLFVGGVEHRLEAAUNWTR-NH2 ♂ | 1714 |
| 1399 | Ac-YVGGVEHRLEAAUNWTRGERUDLEDRDRSELSPL-NH2 | 1715 |
| 1400 | MVYPSDEYDASISQVNEEINQALAYIRKADELLENV | 1218 |
| 1402 | Ac-GPLLVLQAGFFLLTRILTIPQSLDSWWTSLNFLGG-NH2 | 1220 |
| 1403 | Ac-LGPLLVLQAGFFLLTRILTIPQSLDSWWTSLNFLG-NH2 | 1221 |
| 1404 | Ac-FLGPLLVLQAGFFLLTRILTIPQSLDSWWTSLNFL-NH2 | 1222 |
| 1405 | Ac-YTNTIYTLLEESQNQQEKNEQELLELDKWASLWNWF-NH2 | 1357 |
| 1406 | YTNTIYTLLEESQNQQEKNEQELLELDKWASLWNWF | 1357 |
| 1407 | Ac-YTGIIYNLLEESQNQQEKNEQELLELDKWANLWNWF-NH2 | 1358 |
| 1408 | YTGIIYNLLEESQNQQEKNEQELLELDKWANLWNWF | 1359 |
| 1409 | Ac-YTSLIYSLLEKSQIQQEKNEQELLELDKWASLWNWF-NH2 | 1360 |
| 1410 | YTSLIYSLLEKSQIQQEKNEQELLELDKWASLWNWF | 1360 |
| 1411 | Ac-EKSQIQQEKNEQELLELDKWA-NH2 | 1362 |
| 1412 | EKSQIQQEKNEQELLELDKWA | 1362 |
| 1413 | Ac-EQAQIQQEKNEYELQKLDKWA-NH2 | 1364 |
| 1414 | Ac-YTSLIGSLIEESQIQQERNEQELLELDRWASLWEWF-NH2 | 1223 |
| 1415 | Ac-YTXLIHSLIXESQNQQXKNEQELXELDKWASLWNWF-NH2 | 1366 |
| 1416 | Ac-YTXLIHSLIWESQNQQXKNEQELXELD-NH2 | 1716 |
| 1417 | Ac-YTSLIHSLIEESQNQQEKNEQELLELD-NH2 | 1368 |
| 1418 | Ac-WQEQEXKITALLXQAQIQQXKNEYELXKLDKWASLWEWF-NH2 | 1717 |
| 1419 | Ac-XKITALLXQAQIQQXKNEYELXKLDKWASLWEWF-NH2 | 1370 |
| 1420 | Ac-WQEWWXKITALLXQAQIQQXKNEYELXKLD-NH2 | 1718 |
| 1421 | Ac-WEQKITALLEQAQIQQEKNEYELQKLD-NH2 | 1372 |
| 1422 | Ac-WEXKITALLXQAQIQQXKNEYELXKLD-NH2 | 1719 |
| 1423 | Ac-XKITALLXQAQIQQXKNEYELXKLD-NH2 | 1374 |
| 1425 | Ac-QKITALLEQAQIQQEKNEYELQKLD-NH2 | 1375 |
| 1426 | Ac-QKITALLEQAQIQQEKNEYELQKLDKWASLWEWF-NH2 | 1381 |
| 1427 | Ac-WQEWEQKITALLEQAQIQQEKNEYELQKLD-NH2 | 1379 |
| 1428 | Ac-VYPSDEYDASISQVNEEINQALAYIRKADELLEN-OH | 1237 |
| 1429 | Ac-VYPSDEYDASISQVNEEINQALAYIRKADELLE-OH | 1237 |
| 1430 | Ac-VYPSDEYDASISQVNEEINQALAYIRKADELL-OH | 1376 |
| 1431 | Ac-VYPSDEYDASISQVNEEINQALAYIRKADEL-OH | 1378 |
| 1432 | YPSDEYDASISQVNEEINQALAYIRKADELLENV-NH2 | 1227 |
| 1433 | PSDEYDASISQVNEEINQALAYIRKADELLENV-NH2 | 1228 |
| 1434 | SDEYDASISQVNEEINQALAYIRKADELLENV-NH2 | 1229 |
| 1435 | DEYDASISQVNEEINQALAYIRKADELLENV-NH2 | 1230 |
| 1436 | Ac-VYPSDEYDASISQVDEEINQALAYIRKADELLENV-NH2 | 1231 |
| 1437 | Ac-VYPSDEYDASISQVNEEIDQALAYIRKADELLENV-NH2 | 1232 |
| 1438 | Ac-VYPSDEYDASISQVNEEINQALAYIRKADELLEDV-NH2 | 1233 |
| 1439 | Ac-VYPSDEYDASISQVDEEIDQALAYIRKADELLENV-NH2 | 1234 |
| 1440 | Ac-LLSTNKAVVSLSNGVSVLTSKVLDLKNYIDKQLLP-NH2 | 1235 |
| 1441 | Ac-LSTNKAVVSLSNGVSVLTSKVLDLKNYIDKQLLPI-NH2 | 1236 |
| 1442 | Ac-STNKAVVSLSNGVSVLTSKVLDLKNYIDKQLLPIV-NH2 | 1382 |
| 1443 | Ac-TNKAVVSLSNGVSVLTSKVLDLKNYIDKQLLPIVN-NH2 | 1383 |
| 1444 | Ac-NKAVVSLSNGVSVLTSKVLDLKNYIDKQLLPIVNK-NH2 | 1384 |
| 1445 | Ac-KAVVSLSNGVSVLTSKVLDLKNYIDKQLLPIVNKQ-NH2 | 1385 |
| 1446 | Ac-AVVSLSNGVSVLTSKVLDLKNYIDKQLLPIVNKQS-NH2 | 1155 |
| 1447 | Ac-VVSLSNGVSVLTSKVLDLKNYIDKQWLLPIVNKQSU-NH2 | 1721 |
| 1448 | Ac-VSLSNGVSVLTSKVLDLKNYIDKQLLPIVNKQSUS-NH2 | 1722 |
| 1449 | Ac-SLSNGVSVLTSKVLDLKNYIDKQLLPIVNKQSUSI-NH2 | 1723 |
| 1450 | Ac-LSNGVSVLTSKVLDLKNYIDKQLLPIVNKQSUSIS-NH2 | 1724 |
| 1451 | Ac-SNGVSVLTSKVLDLKNYIDKQLLPIVNKQSUSISN-NH2 | 1725 |
| 1452 | Ac-NGVSVLTSKVLDLKNYIDKQLLPIVNKQSUSISNI-NH2 | 1726 |
| 1453 | Ac-GVSVLTSKVLDLKNYIDKQLLPIVNKQSUSISNIE-NH2 | 1727 |
| 1454 | Ac-VSVLTSKVLDLKNYIDKQLLPIVNKQSUSISINIET-NH2 | 1728 |
| 1455 | Ac-SVLTSKVLDLKNYIDKQLLPIVNKQSUSISNIETV-NH2 | 1729 |
| 1456 | Ac-VLTSKVLDLKNYIDKQLLPIVNKQSUSISNIETVI-NH2 | 1730 |
| 1457 | Ac-LTSKVLDLKNYIDKQLLPIVNKQSUSISNIETVIE-NH2 | 1731 |
| 1458 | Ac-TSKVLDLKNYIDKQLLPIVNKQSUSISNIETVIEF-NH2 | 1732 |
| 1459 | Ac-SKVLDLKNYIDKQLLPIVNKQSUSISNIETVIEFQ-NH2 | 1733 |
| 1460 | Ac-KVLDLKNYIDKQLLPIVNKQSUSISNIETVIEFQQ-NH2 | 1734 |
| 1461 | Ac-VLDLKNYIDKQLLPIVNKQSUSISNIETVIEFQQK-NH2 | 1735 |
| 1462 | Ac-LDLKNYIDKQLLPIVNKQSUSISNIETVIEFQQKN-NH2 | 1736 |
| 1463 | Ac-DLKNYIDKQLLPIVNKQSUSISNIETVIEFQQKNN-NH2 | 1737 |
| 1464 | Ac-LKNYIDKQLLPIVNKQSUSISNIETVIEFQQKNNR-NH2 | 1738 |
| 1465 | Ac-KNYIDKQLLPIVNKQSUSISNIETVIEFQQKNNRL-NH2 | 1739 |
| 1466 | Ac-NYIDKQLLPIVNKQSUSISNIETVIEFQQKNNRLL-NH2 | 1740 |
| 1467 | Ac-YIDKQLLPIVNKQSUSISNIETVIEFQQKNNRLLE-NH2 | 1741 |

TABLE 2-continued

| T No. | Sequence | Seq. ID No. |
|---|---|---|
| 1468 | Ac-IDKQLLPIVNKQSUSISNIETVIEFQQKNNRLLEI-NH2 | 1742 |
| 1469 | Ac-DKQLLPIVNKQSUSISNIETVIEFQQKNNRLLEIT-NH2 | 1743 |
| 1470 | Ac-KQLLPIVNKQSUSISNIETVIEFQQKNNRLLEITR-NH2 | 1744 |
| 1471 | Ac-QLLPIVNKQSUSISNIETVIEFQQKNNRLLEITRE-NH2 | 1745 |
| 1472 | Ac-VYPSDEYDASISQVNEEINQALA | 1412 |
| 1473 | QVNEEINQALAYIRKADELLENV-NH2 | 1413 |
| 1474 | VYPSDEYDASISQVNEEINQALAYIRKADELLENV | 1414 |
| 1475 | Ac-DEYDASISQVNEEINQALAYIREADEL-NH2 | 1415 |
| 1476 | Ac-DEYDASISQVNEKINQALAYIREADEL-NH2 | 1416 |
| 1477 | Ac-DDECLNSVKNGTYDFPKFEEESKLNRNEIKGVKLS-NH2 | 1417 |
| 1478 | Ac-DDE-Abu-LNSVKNGTYDFPKFEEESKLNRNEIKGVKLS-NH2 | 1746 |
| 1479 | Ac-YHKCDDECLNSVKNGTFDFPKFEEESKLNRNEIKGVKLSS-NH2 | 1747 |
| 1480 | Ac-YHK-Abu-DDE-Abu-LNSVKNGTFDFPKFEEESKLNRNEIKGVKLSS-NH2 | 1748 |
| 1481 | Ac-YTSLIHSLIEESQIQQEKNEQELLELDKWASLWNWF-NH2 | 1749 |
| 1482 | Ac-YTSLIHSLIEESQNQQEKNEYELLELDKWASLWNWF-NH2 | 1750 |
| 1483 | Ac-YTSLIHSLIEESQIQQEKNEYELLELDKWASLWNWF-NH2 | 1751 |
| 1484 | Ac-YTSLIHSLIEESQIQQEKNEYELQKLDKWASLWNWF-NH2 | 1244 |
| 1485 | Ac-YTSLIHSLIEESQNQQEKNEQELQKLDKWASLWNWF-NH2 | 1245 |
| 1486 | Ac-YTSLIHSLIEESQNQQEKNEYELQKLDKWASLWNWF-NH2 | 1421 |
| 1487 | Ac-YTSLIHSLIEESQIQQEKNEQELQKLDKWASLWNWF-NH2 | 1422 |
| 1488 | Ac-YTSLIHSLIEESQNQQEKNEQELLELDKWASLWEWF-NH2 | 1423 |
| 1489 | Ac-YTSLIHSLIEESQIQQEKNEQELLELDKWASLWEWF-NH2 | 1424 |
| 1490 | Ac-YTSLIHSLIEESQNQQEKNEYELLELDKWASLWEWF-NH2 | 1425 |
| 1491 | Ac-YTSLIHSLIEESQIQQEKNEYELLELDKWASLWEWF-NH2 | 1426 |
| 1492 | Ac-YTSLIHSLIEESQIQQEKNEYELQKLDKWASLWEWF-NH2 | 1752 |
| 1493 | Ac-YTSLIHSLIEESQNQQEKNEQELQKLDKWASLWEWF-NH2 | 1428 |
| 1494 | Ac-YTSLIHSLIEESQNQQEKNEYELQKLDKWASLWEWF-NH2 | 1429 |
| 1495 | Ac-YTSLIHSLIEESQIQQEKNEQELQKLDKWASLWEWF-NH2 | 1430 |
| 1496 | Ac-WQEWEQKITALLEQAQIQQEKNEYELQKLDKEWWF-NH2 | 1753 |
| 1497 | Ac-WQEWEQKITALLEQAQIQQEKNEYELQKLIEWASLWEWF-NH2 | 1432 |
| 1498 | Ac-WQEWEQKITALLEQAQIQQEKNEYELQKLAKWASLWEWF-NH2 | 1256 |
| 1499 | Ac-WQEWEQKITALLEQAQIQQEKNEYELQKLIKWASLWEWF-NH2 | 1257 |
| 1500 | Ac-WQEWEQKITALLEQAQIQQEKNEYELQKLIEWAGLWEWF-NH2 | 1258 |
| 1501 | Ac-WQEWEQKITALLEQAQIQQEKNEYELQKLAKWAGLWEWF-NH2 | 1260 |
| 1502 | Ac-WQEWEQKITALLEQAQIQQEKNEYELQKLIKWAGLWEWF-NH2 | 1259 |
| 1503 | Ac-WQEWEQKITALLEQAQIQQEKNEYELQKLIEWAGLWAWF-NH2 | 1261 |
| 1504 | Ac-WQEWEQKITALLEQAQIQQEKNEYELQKLAKWAGLWAWF-NH2 | 1262 |
| 1505 | Ac-WQEWEQKITALLEQAQIQQEKNEYELQKLIKWAGLWAWF-NH2 | 1263 |
| 1506 | Ac-WQEWEQKITALLEQAQIQQEKGEYELQKLDKQEQF-NH2 | 1267 |
| 1507 | Ac-WQEWEQKITALLEQAQIQQEKGEYELLELDKWEWF-NH2 | 1265 |
| 1508 | Ac-WQEWEQKITALLEQAQIQQEKGEYELQKLAKWEWF-NH2 | 1266 |
| 1509 | Ac-WQEWEQKITALLEQAQIQQEKGEYELQKLDWQWEF-NH2 | 1754 |
| 1510 | Ac-WQEWEQKITALLEQAQIQQEKGEYELLELAKWEWF-NH2 | 1268 |
| 1511 | Ac-WEQWEQKITALLEQAQIQQEKNEYELLELDKWEWF-NH2 | 1755 |
| 1512 | Ac-WQEWEQKITALLEQAQIQQEKNEYELEEELIEWASLWEWF-NH2 | 1756 |
| 1513 | Ac-WQEWEQKITALLEQAQIQQEKNEYELLELIEWAGLWEWF-NH2 | 1271 |
| 1514 | Ac-WQEWEQKITALLEQAQIQQEKNEYELLELIEWAGLWAWF-NH2 | 1272 |
| 1515 | Ac-WQEWEREITALLEQAQIQQEKNEYELQKLIEWASLWEWF-NH2 | 1273 |
| 1516 | Ac-WQEWEREIQQEKNEYELQKLDKWASLWEWF-NH2 | 1274 |
| 1517 | Ac-WQEWEREIQQEKGEYELQKLIEWEWF-NH2 | 1275 |
| 1518 | Ac-WQEWQAQIQQEKNEYELQKLDKWASLWEWF-NH2 | 1757 |
| 1519 | Ac-WQEWQAQIQQEKGEYELQKLIEWEWF-NH2 | 1277 |
| 1520 | PEG-GWQEWEQRITALLEQAQIQQERNEYELQRLDEWASLWEWF-NH2 | 1439 |
| 1521 | Ac-GWQEWEQRITALLEQAQIQQERNEYELQRLDEWASLWEWF-NH2 | 1438 |
| 1522 | PEG-YTSLITALLEQAQIQQERNEQELLELDEWASLWEWF-NH2 | 1441 |
| 1523 | Ac-YTSLITALLEQAQIQQERNEQELLELDEWASLWEWF-NH2 | 1440 |
| 1526 | PEG-GWQEWEQRITALLEQAQIQQERNEYELQELDEWASLWEWF-NH2 | 1443 |
| 1527 | Ac-GWQEWEQRITALLEQAQIQQERNEYELQELDEWASLWEWF-NH2 | 1442 |
| 1528 | PEG-YTSLIGSLIEESQIQQERNEQELLELDRWASLWEWF-NH2 | 1444 |
| 1529 | PEG-GWQEWEQRITALLEQAQIQQERNEYELQRLDRWASLWEWF-NH2 | 1445 |
| 1530 | Ac-GWQEWEQRITALLEQAQIQQERNEYELQRLDRWASLWEWF-NH2 | 1445 |
| 1531 | PEG-GWQEWEQRITALLEQAQIQQERNEYELQELDRWASLWEWF-NH2 | 1447 |
| 1532 | Ac-GWQEWEQRITALLEQAQIQQERNEYELQELDRWASLWEWF-NH2 | 1447 |
| 1533 | PEG-YTSLIGSLIEESQNQQERNEQELLELDRWASLWNWF-NH2 | 1449 |
| 1534 | Ac-YTSLIGSLIEESQNQQERNEQELLELDRWASLWNWF-NH2 | 1449 |
| 1538 | Ac-YTSLIHSLIEESQNQQEK-OH | 225 |
| 1539 | NEQELLELDK | 631 |
| 1540 | WASLWNWF-NH2 | 222 |
| 1542 | Ac-AAAWEQKITALLEQAQIQQEKNEYELQKLDKWASLWEWF-NH2 | 1453 |
| 1543 | Ac-WQEAAAKITALLEQAQIQQEKNEYELQKLDKWASLWEWF-NH2 | 1454 |
| 1544 | Ac-WQEWEQAAAALLEQAQIQQEKNEYELQKLDKWASLWEWF-NH2 | 1455 |
| 1545 | Ac-WQEWEQKITAAAEQAQIQQEKNEYELQKLDKWASLWEWF-NH2 | 1456 |
| 1546 | Ac-WQEWEQKITALLAAAQIQQEKNEYELQKLDKWASLWEWF-NH2 | 1457 |
| 1547 | Ac-WQEWEQKITALLEQAAAAQEKNEYELQKLDKWASLWEWF-NH2 | 1458 |
| 1548 | Ac-WQEWEQKITALLEQAQIQAAANEYELQKLDKWASLWEWF-NH2 | 1459 |
| 1549 | Ac-WQEWEQKITALLEQAQIQQEKAAAELQKLDKWASLWEWF-NH2 | 1460 |

TABLE 2-continued

| T No. | Sequence | Seq. ID No. |
|---|---|---|
| 1550 | Ac-WQEWEQKITALLEQAQIQQEKNEYAAAKLDKWASLWEWF-NH2 | 1461 |
| 1551 | Ac-WQEWEQKITALLEQAQIQQEKNEYELQAAAKWASLWEWF-NH2 | 1462 |
| 1552 | Ac-WQEWEQKITALLEQAQIQQEKNEYELQKLDAAASLWEWF-NH | 1463 |
| 1553 | Ac-WQEWEQKITALLEQAQIQQEKNEYELQKLDKWAAAAEWF-NH | 1464 |
| 1554 | Ac-WQEWEQKITALLEQAQIQQEKNEYELQKLDKWASLWAAA-NH | 1465 |
| 1556 | Ac-YTSLIHSLIEESQNQQEKNEQELLLDKWASLWNWF-NH2 | 1466 |
| 1557 | Ac-YTSLIHSLIEESQNQEKNEQELLELDKWASLWNWF-NH2 | 1467 |
| 1558 | Ac-ERTLDFHDS-NH2 | 1468 |
| 1559 | Ac-YTSLIHSLIEESQNQQEKNEQELLELDKWASLWN(W)F-NH2 | 1469 |
| 1563 | Ac-YTSLIHSLIEESQN(Q)QEKNEQELLELDKWASLWNWF-NH2 | 1470 |
| 1564 | Ac-YTSLIHSLIEESQNQQDKWASLWNWF-NH2 | 1471 |
| 1566 | Ac-FYEIIMDIEQNNVQGKKGIQQLQKWEDWVGWIGNI-NH2 | 1472 |
| 1567 | Ac-INQTIWNHGNITLGEWYNQTKDLQQKFYEIIMDIE-NH2 | 1473 |
| 1568 | Ac-WNHGNITLGEWYNQTKDLQQKFYEIIMDIEQNNVQ-NH2 | 1474 |
| 1572 | Ac-YTSLIHSLIEESENQQEKNEQELLELDKWASLWNWF-NH2 | 1475 |
| 1573 | Ac-YTSLIHSLIEESQDQQEKNEQELLELDKWASLWNWF-NH2 | 1476 |
| 1574 | Ac-YTSLIHSLIEESQNEQEKNEQELLELDKWASLWNWF-NH2 | 1477 |
| 1575 | c-YTSLIHSLIEESQNQEEKNEQELLELDKWASLWNWF-NH2 | 1478 |
| 1576 | Ac-YTSLIHSLIEESQNQQEKDEQELLELDKWASLWNWF-NH2 | 1479 |
| 1577 | Ac-LGEWYNQTKDLQQKFYEIIMDIEQNNVQGKKGIQQ-NH2 | 1480 |
| 1578 | Ac-WYNQTKDLQQKFYEIIMDIEQNNVQGKKGIQQLQK-NH2 | 1481 |
| 1579 | Ac-YTSLIHSLIEESQNQQEKNEEELLELDKWASLWNWF-NH2 | 1482 |
| 1580 | Ac-YTSLIHSLIEESQNQQEKNEQELLELDKWASLWDWF-NH2 | 1483 |
| 1586 | Ac-XTSLIHSLIEESQNQQEKNEQELLELDKWASLWNWX-NH2 | 1484 |
| 1588 | Ac-YNQTKDLQQKFYEIIMDIEQNNVQGKKGIQQLQKW-NH2 | 1485 |
| 1598 | Ac-YTSLIHSLIEESQNQQEKNEQELLELDKWASLWNWF | 1486 |
| 1600 | Ac-TLTVQARQLLSGIVQQQNNLLRAIEAQQHLLQLTVWGIKQLQAR-NH2 | 1487 |
| 1603 | Ac-LQQKFYEIIMDIEQNNVQGKKGIQQLQKWEDWVGW-NH2 | 1488 |
| 1627 | Ac-YTSLIHSLIEESQNQQEKNEQELLALDKWASLWNWF-NH2 | 1489 |
| 1628 | Ac-YTSLIHSLIEESQNQQEKNEQELLEADKWASLWNWF-NH2 | 1490 |
| 1629 | Ac-YTSLIHSLIEESQNQQEKNEQELLELAKWASLWNWF-NH2 | 1491 |
| 1630 | Ac-YTSLIHSLIEESQNQQEKAEQELLELDKWASLWNWF-NH2 | 1492 |
| 1631 | Ac-YTSLIHSLIEESQNQQEKNAQELLELDKWASLWNWF-NH2 | 1493 |
| 1632 | Ac-YTSLIHSLIEESQNQQEKNEAELLELDKWASLWNWF-NH2 | 1494 |
| 1634 | Ac-WQEWEQKITALLEQAQIQQEKNEQELQKLDKWASLWEWF-NH2 | 1495 |
| 1635 | Ac-WQEWEQKITALLEQAQIQQEKAEYELQKLDKWASLWEWF-NH2 | 1496 |
| 1636 | Ac-WQEWEQKITALLEQAQIQQEKNAYELQKLDKWASLWEWF-NH2 | 1497 |
| 1637 | Ac-WQEWEQKITALLEQAQIQQEKNEAELQKLDKWASLWEWF-NH2 | 1498 |
| 1644 | Ac-EYDLRRWEK-NH2 | 1499 |
| 1645 | Ac-EQELLELDK-NH2 | 1500 |
| 1646 | Ac-EYELQKLDK-NH2 | 1501 |
| 1647 | Ac-WQEWEQKITALLEQAQIQQEKNEQELLKLDKWASLWEWF-NH2 | 1502 |
| 1648 | Ac-WQEWEQKITALLEQAQIQQEKNEQELLELDKWASLWEWF-NH2 | 1503 |
| 1649 | Ac-WQEWEQKITALLEQAQIQQEKNDKWASLWEWF-NH2 | 1504 |
| 1650 | Ac-YTSLIHSLIEESQNQAEKNEQELLELDKWASLWNWF-NH2 | 1505 |
| 1651 | Ac-YTSLIHSLIEESQNQQAKNEQELLELDKWASLWNWF-NH2 | 1506 |
| 1652 | Ac-YTSLIHSLIEESQNQQEANEQELLELDKWASLWNWF-NH2 | 1507 |
| 1653 | Ac-YTSLIHSLIEESANQQEANEQELLELDKWASLWNWF-NH2 | 1508 |
| 1654 | Ac-YTSLIHSLIEESQAQQEKNEQELLELDKWASLWNWF-NH2 | 1509 |
| 1655 | Ac-YTSLIHSLIEESQNAQEKNEQELLELDKWASLWNWF-NH2 | 1510 |
| 1656 | Ac-YTSLIHALIEESQNQQEKNEQELLELDKWASLWNWF-NH2 | 1511 |
| 1657 | Ac-YTSLIHSAIEESQNQQEKNEQELLELDKWASLWNWF-NH2 | 1512 |
| 1658 | Ac-VYPSDEYDASISQVNEEINQALAYIRKADELLENV-NH2 | 1513 |
| 1659 | Ac-YTSLIHSLAEESQNQQEKNEQELLELDKWASLWNWF-NH2 | 1514 |
| 1660 | Ac-YTSAIHSLIEESQNQQEKNEQELLELDKWASLWNWF-NH2 | 1515 |
| 1661 | Ac-YTSLAHSLIEESQNQQEKNEQELLELDKWASLWNWF-NH2 | 1516 |
| 1662 | Ac-YTSLIASLIEESQNQQEKNEQELLELDKWASLWNWF-NH2 | 1517 |
| 1663 | Ac-ATSLIHSLIEESQNQQEKNEQELLELDKWASLWNWF-NH2 | 1518 |
| 1664 | Ac-YASLIHSLIEESQNQQEKNEQELLELDKWASLWNWF-NH2 | 1519 |
| 1665 | Ac-YTALIHSLIEESQNQQEKNEQELLELDKWASLWNWF-NH2 | 1520 |
| 1666 | Ac-RIQDLEKYVEDTKIDLWSYNAELLVALENQ-NH2 | 1521 |
| 1667 | Ac-HTIDLTDSEMNKLFEKTRRQLREN-NH2 | 1522 |
| 1668 | Ac-SEMNKLFEKTRRQLREN-NH2 | 1523 |
| 1669 | Ac-VFPSDEADASISQVNEKINQSLAFIRKSDELLHNV-NH2 | 1524 |
| 1670 | Ac-VFPSDEFAASISQVNEKINQSLAFIRKSDELLHNV-NH2 | 1525 |
| 1671 | Ac-VFPSDEFDASISAVNEKINQSLAFIRKSDELLHNV-NH2 | 1526 |
| 1672 | Ac-VFPSDEFDASISQANEKINQSLAFIRKSDELLHNV-NH2 | 1527 |
| 1673 | Ac-VFPSDEFDASISQVAEKINQSLAFIRKSDELLHNV-NH2 | 1528 |
| 1674 | Ac-WQEWEQKITAALEQAQIQQEKNEYELQKLDKWASLWEWF-NH2 | 1529 |
| 1675 | Ac-WQEWEQKITALAEQAQIQQEKNEYELQKLDKWASLWEWF-NH2 | 1530 |
| 1676 | Ac-WQEWEQKITALLEQAAIQQEKNEYELQKLDKWASLWEWF-NH2 | 1531 |
| 1677 | Ac-WQEWEQKITALLEQAQAQQEKNEYELQKLDKWASLWEWF-NH2 | 1532 |
| 1678 | Ac-WQEWEQKITALLEQAQIAEKNEYELQKLDKWASLWEWF-NH2 | 1533 |
| 1679 | Ac-WQEWEQKITALLEQAQIQAEKNEYELQKLDKWASLWEWF-NH2 | 1534 |
| 1680 | Ac-VFPSDEFDASISQVNEKINQSAAFIRKSDELLHNV-NH2 | 1535 |
| 1681 | Ac-VFPSDEFDASISQVNEKINQSLAAIRKSDELLHNV-NH2 | 1536 |

TABLE 2-continued

| T No. | Sequence | Seq. ID No. |
|---|---|---|
| 1682 | Ac-VFPSDEFDASISQVNEKINQSLAFIRKSDEALHNV-NH2 | 1537 |
| 1683 | Ac-VFPSDEFDASISQVNEKINQSLAFIRKSDELAHNV-NH2 | 1538 |
| 1684 | Ac-VFPSDEFDASISQVNEKINQSLAFIRKSDELLANV-NH2 | 1539 |
| 1685 | Ac-WQEWEQKITALLEQAQIQQAKNEYELQKLDKWASLWEWF-NH2 | 1540 |
| 1687 | Ac-WQEWEQKITALLEQAQIQQEKNEYELQALDKWASLWEWF-NH2 | 1541 |
| 1688 | Ac-WQEWEQKITALLEQAQIQQEKNEYELQKADKWASLWEWF-NH2 | 1542 |

It is to be understood that the peptides listed in Table 2 and in the Example presented in Section 11, below, are also intended to fall within the scope of the present invention. As discussed above, those peptides depicted in Table 2 and in the Example presented, below, that do not already contain enhancer peptide sequences (that is, do not represent hybrid polypeptides) can be utilized in connection with the enhancer peptide sequences and teaching provided herein to generate hybrid polypeptides. Further, the core polypeptides and the core polypeptide of the hybrid polypeptides shown in Table 2, FIG. 13 and the Example presented in Section 11, below, can be used with any of the enhancer peptide sequences described herein to routinely produce additional hybrid polypeptides, which are also intended to fall within the scope of the present invention.

For example, peptide DP397, depicted in the Example presented in Section 11 represents a core polypeptide, and is intended to fall within the scope of the present invention. In addition, hybrid polypeptides comprising the DP397 core polypeptide plus one or more enhancer polypeptide sequences described herein are also intended to fall within the scope of the present invention.

It is noted that while a number of the polypeptides listed in Table 2 and FIG. 13 are depicted with modified, e.g., blocked amino and/or carboxy termini or d-isomeric amino acids (denoted by residues within parentheses), it is intended that any polypeptide comprising a primary amino acid sequence as depicted to Table 2 and FIG. 13 is also intended to be part of the present invention.

The core polypeptide sequences, per se, shown in Table 2, FIG. 13 and the Example presented, below, in Section 11, as well as the hybrid polypeptides comprising such core polypeptides, can exhibit antiviral, and/or anti-fusogenic activity and/or can exhibit an ability to modulate intercellular processes that involve coiled-coil peptide structures. In addition, such peptides can also be utilized as part of screening methods for identifying compounds, including peptides, with such activities. Among the core polypeptide sequences are, for example, ones which have been derived from individual viral protein sequences. Also among the core polypeptide sequences are, for example, ones whose amino acid sequences are derived from greater than one viral protein sequence (e.g., an HIV-1, HIV-2 and SIV -derived core polypeptide).

In addition, such core polypeptides can exhibit amino acid substitutions, deletions and/or insertions as discussed, above, for enhancer polypeptide sequences. In instances wherein the core polypeptide exhibits antiviral and/or anti-fusogenic activity such modifications preferably do not abolish (either per se or as part of a hybrid polypeptide) this activity.

With respect to amino acid deletions, it is preferable that the resulting core polypeptide is at least about 4–6 amino acid residues in length. With respect to amino acid insertions, preferable insertions are no greater than about 50 amino acid residues, and, more preferably no more than about 15 amino acid residues. It is also preferable that core polypeptide insertions be amino- and/or carboxy-terminal insertions.

Among the amino acid substitutions, deletions, and/or insertions of the core or hybrid polypeptides of the invention are ones which correspond to amino acid substitutions, deletions and/or insertions found in mutants, e.g., naturally occurring mutants, of the endogenous protein sequence from which a particular core polypeptide is derived.

For example, if the core polypeptide is derived from a viral protein, and this core polypeptide (either per se or as part of a hybrid polypeptide) exhibits antiviral activity against that or another virus, it is possible that variants (e.g., variant strains) of the virus may exist or may ultimately arise that exhibit some level of resistance to the peptide relative to the peptide's antiviral effect on the virus strain from which the original endogenous core polypeptide sequence was derived.

In order to generate core polypeptides that exhibit antiviral activity toward such resistant virus strains, modifications to the original core polypeptide can be introduced. In particular, isolates of the resistant virus can readily be isolated by one of skill in the art using standard techniques. Determination of the sequence within the resistant virus corresponding to the original core polypeptide can also routinely be determined and compared to the original core polypeptide.

In the event the corresponding sequence obtained from the mutant, resistant strain differs from the sequence of the core polypeptide, modifications to the core polypeptide can be introduced such that the resulting modified core polypeptide has the same sequence as the corresponding region in the resistant virus.

The resulting modified core polypeptide, either per se or as part of a hybrid polypeptide, will exhibit antiviral properties against the viral strain that had been resistant to the original core polypeptide. Such methods can be utilized, therefore, to identify core polypeptides that exhibit antiviral activity against virus strains that are or have become resistant to the antiviral activity of other core polypeptides.

One particular, but non-limiting example of the successful use of such a method to produce a modified core polypeptide that exhibits antiviral activity against a viral strain resistant to a "parent" core polypeptide is described in the Example presented, below, in Section 11.

In one embodiment, such modified core polypeptides that exhibit antiviral activity against strains resistant to the "parent" core polypeptide are ones in which amino acid substitutions, insertions and/or deletions have been introduced which modify the "parent" core polypeptide such that an N-glycosylation or O-glycosylation consensus sequence that was present in the "parent" core polypeptide has been abolished in the resulting modified core polypeptide.

For example, the consensus sequence for an N-glycosylation site is -N-X-S/T, where S/T is either serine or threonine and X is any amino acid except proline or aspartic acid. Thus, in one embodiment, a parent core polypeptide exhibiting such a consensus sequence can be modified via amino acid insertion, substitution and/or deletion such that this consensus sequence is abolished in the modified core polypeptide.

Among such amino and/or carboxy-terminal insertions are ones which comprise amino acid sequences amino and/or carboxy to the endogenous protein sequence from which the core polypeptide is derived. For example, if the core polypeptide is derived from gp41 protein, such an insertion would comprise an amino and/or carboxy-terminal insertion comprising a gp41 amino acid sequence adjacent to the gp4 core polypeptide sequence. Such amino and/or carboxy terminal insertions can typically range from about 1, 5, 10, 15, 20, 25, 30, 35, 40, 45 or 50 amino acid residues amino to and/or carboxy to the original core polypeptide.

The hybrid polypeptides of the invention can still further comprise additional modifications that readily allow for detection of the polypeptide. For example, the hybrid polypeptides can be labeled, either directly or indirectly. Peptide labeling techniques are well known to those of skill in the art and include, but are not limited to, radioactive, fluorescent and colorimetric techniques. Indirect labeling techniques are also well known to those of skill in the art and include, but are not limited to, biotin/streptavidin labeling and indirect antibody labeling.

The invention further relates to the association of the enhancer polypeptide sequences to types of molecules other than peptides. For example, the enhancer peptide sequences may be linked to nucleic acid molecules (e.g., DNA or RNA) or any type of small organic molecule for the purpose of enhancing the pharmacokinetic properties of said molecules.

5.2. SYNTHESIS OF PEPTIDES

The enhancer, core and hybrid polypeptides of the invention may be synthesized or prepared by techniques well known in the art. See, for example, Creighton, 1983, Proteins: Structures and Molecular Principles, W.H. Freeman and Co., NY, which is incorporated herein by reference in its entirety. Hybrid polypeptides may be prepared using conventional step-wise solution or solid phase synthesis, fragment condensation, Fmoc or Boc chemistry. (see, e.g., Chemical Approaches to the Synthesis of Peptides and Proteins, Williams et al., Eds., 1997, CRC Press, Boca Raton Fla., and references cited therein; Solid Phase Peptide Synthesis: A Practical Approach, Atherton & Sheppard, Eds., 1989, IRL Press, Oxford, England, and references cited therein). Likewise the amino- and/or carboxy-terminal modifications.

In general, these methods can comprise the sequential addition of one or more amino acids or suitably protected amino acids to a growing peptide chain. Normally, either the amino or carboxyl group of the first amino acid is protected by a suitable protecting group. The protected or derivatized amino acid can then be either attached to an inert solid support or utilized in solution by adding the next amino acid in the sequence having the complementary (amino or carboxyl) group suitably protected, under conditions suitable for forming the amide linkage. The protecting group is then removed from this newly added amino acid residue and the next amino acid (suitably protected) is then added, and so forth. After all the desired amino acids have been linked in the proper sequence, remaining protecting groups and any solid support can be removed either sequentially or concurrently to afford the desired final polypeptide. By simple modification of this general procedure, it is possible to add more than one amino acid at a time to a growing chain, for example, by coupling (under condition that do not racemize chiral centers) a protected tripeptide with a properly protected dipeptide to form, after deprotection, a pentapeptide.

Typical protecting groups include T-butyloxycarbonyl (Boc), 9-fluorenylmethoxycarbonyl (Fmoc), benxyloxycarbonyl (Cbz), p-toluenesulfonyl (Tos); 2,4-dinitrophenyl, benzyl (Bzl), biphenylisopropyloxy-carboxycarbonyl, cyclohexyl, isopropyl, acetyl, o-nitrophenylsulfonyl, and the like. Of these, Boc and Fmoc are preferred.

Typical solid supports are generally cross-linked polymeric materials. These include, but are not limited to, divinylbenzene cross-linked styrene-based polymers, for example, divinylbenzene-hydroxymethylstyrene copolymers, divinylbenzene-chloromethylstyrene copolymers, and divinylbenzene-benzhydrylaminopolystyrene copolymers. Such copolymers offer the advantage of directly introducing a terminal amide functional group into the peptide chain, which function is retained by the chain when the chain is cleaved from the support.

Polypeptides containing either L- or D-amino acids may be synthesized in this manner.

Polypeptide composition can be confirmed by quantitative amino acid analysis and the specific sequence of each peptide may be determined by sequence analysis.

The enhancer, core and hybrid polypeptides of the invention can be purified by art-known techniques such as normal and reverse phase high performance liquid chromatography, ion exchange chromatography, gel electrophoresis, affinity chromatography, size exclusion, precipitation and the like. The actual conditions used to purify a particular polypeptide will depend, in part, on synthesis strategy and on factors such as net charge, hydrophobicity, hydrophilicity, solubility, stability etc., and will be apparent to those having skill in the art.

Hybrid, enhancer and core polypeptides may also be made using recombinant DNA techniques. Here, the nucleotide sequences encoding the polypeptides of the invention may be synthesized, and/or cloned, and expressed according to techniques well known to those of ordinary skill in the art. See, for example, Sambrook, et al., 1989, Molecular Cloning, A Laboratory Manual, Vols. 1–3, Cold Spring Harbor Press, N.Y.

One may obtain the DNA segment encoding the polypeptide of interest using a variety of molecular biological techniques, generally known to those skilled in the art. For example, polymerase chain reaction (PCR) may be used to generate the DNA fragment encoding the protein of interest. Alternatively, the DNA fragment may be obtained from a commercial source.

The DNA encoding the polypeptides of interest may be recombinantly engineered into a variety of host vector systems that also provide for replication of the DNA in large scale. These vectors can be designed to contain the necessary elements for directing the transcription and/or translation of the DNA sequence encoding the hybrid polypeptide.

Vectors that may be used include, but are not limited to, those derived from recombinant bacteriophage DNA, plasmid DNA or cosmid DNA. For example, plasmid vectors such as pcDNA3, pBR322, pUC 19/18, pUC 118, 119 and the M13 mp series of vectors may be used. Bacteriophage vectors may include λgt10, λgt11, λgt18–23, λZAP/R and the EMBL series of bacteriophage vectors. Cosmid vectors that may be utilized include, but are not limited to, pJB8, pCV 103, pCV 107, pCV 108, pTM, pMCS, PNNL, pHSG274, COS202, COS203, pWE15, pWE16 and the charomid 9 series of vectors.

Alternatively, recombinant virus vectors including, but not limited to, those derived from viruses such as herpes virus, retroviruses, vaccinia viruses, adenoviruses, adeno-associated viruses or bovine papilloma viruses plant viruses, such as tobacco mosaic virus and baculovirus may be engineered.

In order to express a biologically active polypeptide, the nucleotide sequence coding for the protein may be inserted into an appropriate expression vector, i.e., a vector which contains the necessary elements for the transcription and translation of the inserted coding sequences. Methods which are well known to those skilled in the art can be used to construct expression vectors having the hybrid polypeptide coding sequence operatively associated with appropriate transcriptional/translational control signals. These methods include in vitro recombinant DNA techniques and synthetic techniques. See, for example, the techniques described in Sambrook, et al., 1992, *Molecular Cloning, A Laboratory Manual*, Cold Spring Harbor Laboratory, N.Y. and Ausubel et al., 1989, *Current Protocols in Molecular Biology*, Greene Publishing Associates & Wiley Interscience, N.Y., each of which are incorporated herein by reference in its entirety.

The nucleic acid molecule encoding the hybrid, enhancer and core polypeptides of interest may be operatively associated with a variety of different promoter/enhancer elements. The promoter/enhancer elements may be selected to optimize for the expression of therapeutic amounts of protein. The expression elements of these vectors may vary in their strength and specificities. Depending on the host/vector system utilized, any one of a number of suitable transcription and translation elements may be used. The promoter may be in the form of the promoter which is naturally associated with the gene of interest. Alternatively, the DNA may be positioned under the control of a recombinant or heterologous promoter, i.e., a promoter that is not normally associated with that gene. For example, tissue specific promoter/enhancer elements may be used to regulate the expression of the transferred DNA in specific cell types.

Examples of transcriptional control regions that exhibit tissue specificity which have been described and could be used include, but are not limited to, elastase I gene control region which is active in pancreatic acinar cells (Swift et al., 1984, *Cell* 38:639–646; Ornitz et al., 1986, *Cold Spring Harbor Symp. Quant. Biol.* 50:399–409; MacDonald, 1987, *Hepatology* 7:42S–51S); insulin gene control region which is active in pancreatic beta cells (Hanahan, 1985, *Nature* 315:115–122); immunoglobulin gene control region which is active in lymphoid cells (Grosschedl et al., 1984, *Cell* 38:647–658; Adams et al., 1985, *Nature* 318:533–538; Alexander et al., 1987, *Mol. Cell. Biol.* 7:1436–1444): albumin gene control region which is active in liver (Pinkert et al., 1987, *Genes and Devel.* 1:268–276) alpha-fetoprotein gene control region which is active in liver (Krumlauf et al., 1985, *Mol. Cell. Biol.* 5:1639–1648; Hammer et al., 1987, *Science* 235:53–58); alpha-1-antitrypsin gene control region which is active in liver (Kelsey et al., 1987, *Genes and Devel.* 1:161–171); beta-globin gene control region which is active in myeloid cells (Magram et al., 1985, *Nature* 315:338–340; Kollias et al., 1986, *Cell* 46:89–94); myelin basic protein gene control region which is active in oligodendrocyte cells in the brain (Readhead et al., 1987, *Cell* 48:703–712); myosin light chain-2 gene control region which is active in skeletal muscle (Shani, 1985, *Nature* 314:283–286); and gonadotropic releasing hormone gene control region which is active in the hypothalamus (Mason et al., 1986, *Science* 234:1372–1378). Promoters isolated from the genome of viruses that grow in mammalian cells, (e.g., vaccinia virus 7.5K, SV40, HSV, adenoviruses MLP, MMTV, LTR and CMV promoters) may be used, as well as promoters produced by recombinant DNA or synthetic techniques.

In some instances, the promoter elements may be constitutive or inducible promoters and can be used under the appropriate conditions to direct high level or regulated expression of the nucleotide sequence of interest. Expression of genes under the control of constitutive promoters does not require the presence of a specific substrate to induce gene expression and will occur under all conditions of cell growth. In contrast, expression of genes controlled by inducible promoters is responsive to the presence or absence of an inducing agent.

Specific initiation signals are also required for sufficient translation of inserted protein coding sequences. These signals include the ATG initiation codon and adjacent sequences. In cases where the entire coding sequence, including the initiation codon and adjacent sequences are inserted into the appropriate expression vectors, no additional translational control signals may be needed. However, in cases where only a portion of the coding sequence is inserted, exogenous translational control signals, including the ATG initiation codon must be provided. Furthermore, the initiation codon must be in phase with the reading frame of the protein coding sequences to ensure translation of the entire insert. These exogenous translational control signals and initiation codons can be of a variety of origins, both natural and synthetic. The efficiency of expression may be enhanced by the inclusion of transcription attenuation sequences, enhancer elements, etc.

5.3. USES OF THE ENHANCER PEPTIDE SEQUENCES, CORE POLYPEPTIDES AND HYBRID POLYPEPTIDES OF THE INVENTION

As discussed above, the enhancer peptide sequences of the invention can be utilized to enhance the pharmacokinetic properties of any core polypeptide through linkage of the core polypeptide to the enhancer peptide sequences to form hybrid polypeptides. The observed enhancement of pharmacokinetic properties is relative to the pharmacokinetic properties of the core polypeptide alone. Standard pharmacokinetic character parameters and methods for determining and characterizing the pharmacokinetic properties of an agent such as a polypeptide are well known to those of skill in the art. Non-limiting examples of such methods are presented in the Examples provided below.

The enhancer peptide sequences of the invention can, additionally, be utilized to increase the in vitro or ex-vivo half-life of a core polypeptide to which enhancer peptide sequences have been attached. For example, enhancer peptide sequences can increase the half life of attached core polypeptides when the resulting hybrid polypeptides are present in cell culture, tissue culture or patient samples, (e.g., cell samples, tissue samples biopsies, or other sample containing bodily fluids).

The core polypeptides and hybrid polypeptides of the invention can also be utilized as part of methods for modulating (e.g., decreasing, inhibiting, disrupting, stabilizing or enhancing) fusogenic events. Preferably, such peptides exhibit antifusogenic or antiviral activity. The peptides of the invention can also exhibit the ability to modulate intracellular processes involving coiled-coil peptide interactions.

In particular embodiments, the hybrid polypeptides and core polypeptides of the invention that exhibit antiviral activity can be used as part of methods for decreasing viral infection. Such antiviral methods can be utilized against, for example, human retroviruses, particularly HIV (human immunodeficiency virus), e.g., HIV-1 and HIV-2, and the human T-lymphocyte viruses (HTLV-I and HTLV-II), and non-human retroviruses, such as bovine leukosis virus, feline sarcoma and leukemia viruses, simian immunodeficiency viruses (SIV), sarcoma and leukemia viruses, and sheep progress pneumonia viruses.

The antiviral methods of the invention can also be utilized against non-retroviral viruses, including, but not limited to, respiratory syncytial virus (RSV), canine distemper virus, newcastle disease virus, human parainfluenza virus, influenza viruses, measles viruses, Epstein-Barr viruses, hepatitis B viruses and Mason-Pfizer viruses.

The above-recited viruses are enveloped viruses. The antiviral methods of the invention can also be utilized against non-enveloped viruses, including but not limited to picornaviruses such as polio viruses, hepatitis A virus, enterovirus, echoviruses, and coxsackie viruses, papovaviruses such as papilloma virus, parvoviruses, adenoviruses and reoviruses.

Other antifusogenic activities that can be modulated via methods that utilize the peptides of the invention include, but are not limited to modulation of neurotransmitter exchange via cell fusion, and sperm-egg fusion. Among the intracellular disorders involving coiled-coil interactions that can be ameliorated via methods that utilize the peptides of the invention are disorder involving, for example, bacterial toxins.

The antifusion or antiviral activity of a given core polypeptide or hybrid polypeptide can routinely be ascertained via standard in vitro, ex vivo and animal model assays that, with respect to antiviral activity, can be specific or partially specific for the virus of interest and are well known to those of skill in the art.

The above description relates mainly to antiviral and antifusion-related activities of core and hybrid polypeptides of the invention. The hybrid polypeptides of the invention can also be utilized as part of any method for which administration or use of the core polypeptide alone might be contemplated. Use of hybrid polypeptides as part of such methods is particularly preferable in instances wherein an increase in the pharmacokinetic properties of the core polypeptide is desired. For example, insulin is utilized as part of treatment for certain types of diabetes. A hybrid polypeptide comprising an insulin or insulin fragment as the core polypeptide can, therefore, also be utilized as part of methods for ameliorating symptoms of forms of diabetes for which insulin is used and/or contemplated.

In addition to the above therapeutic methods, the peptides of the invention can still further be utilized as part of prognostic methods for preventing disorders, including, but not limited to disorders involving fusion events, intracellular processes involving coiled-coil peptides and viral infection that involves cell-cell and/or virus-cell fusion. For example, the core and hybrid polypeptides of the invention can be utilized as part of prophylactic methods of preventing viral infection.

The hybrid polypeptides of the invention can still further be utilized as part of diagnostic methods. Such methods can be either in vivo or in vitro methods. Any diagnostic method that a particular core polypeptide can be utilized can also be performed using a hybrid polypeptide comprising the core polypeptide and a modification or primary amino acid sequence that allows detection of the hybrid polypeptide. Such techniques can reflect an improvement over diagnostic methods in that the increased half life of the hybrid polypeptide relative to the core polypeptide alone can increase the sensitivity of the diagnostic procedure in which it is utilized. Such diagnostic techniques include, but are not limited to imaging methods, e.g., in vivo imaging methods. In a non-limiting example of an imaging method, a structure that binds the core polypeptide of a hybrid polypeptide can be detected via binding to the hybrid polypeptide and imaging (either directly or indirectly) the bound hybrid polypeptide.

5.4. PHARMACEUTICAL FORMULATIONS, DOSAGES AND MODES OF ADMINISTRATION

The peptides of the invention may be administered using techniques well known to those in the art. Preferably, agents are formulated and administered systemically. Techniques for formulation and administration may be found in "Remington's Pharmaceutical Sciences", latest edition, Mack Publishing Co., Easton, Pa. Suitable routes may include oral, rectal, vaginal, lung (e.g., by inhalation), transdermal, transmucosal, or intestinal administration; parenteral delivery, including intramuscular, subcutaneous, intramedullary injections, as well as, intrathecal, direct intraventricular, intravenous, intraperitoneal, intranasal, or intraocular injections, just to name a few. For intravenous injection, the agents of the invention may be formulated in aqueous solutions, preferably in physiologically compatible buffers such as Hanks' solution, Ringer's solution, or physiological saline buffer to name a few. In addition, infusion pumps may be used to deliver the peptides of the invention. For transmucosal administration, penetrants appropriate to the barrier to be permeated are used in the formulation. Such penetrants are generally known in the art.

In instances wherein intracellular administration of the peptides of the invention or other inhibitory agents is preferred, techniques well known to those of ordinary skill in the art may be utilized. For example, such agents may be encapsulated into liposomes, or microspheres then administered as described above. Liposomes are spherical lipid bilayers with aqueous interiors. All molecules present in an aqueous solution at the time of liposome formation are incorporated into the aqueous interior. The liposomal contents are both protected from the external microenvironment and, because liposomes fuse with cell membranes, are effectively delivered into the cell cytoplasm. Additionally, due to their hydrophobicity, when small molecules are to be administered, direct intracellular administration may be achieved.

Nucleotide sequences encoding the peptides of the invention which are to be intracellularly administered may be expressed in cells of interest, using techniques well known to those of skill in the art. For example, expression vectors derived from viruses such as retroviruses, vaccinia viruses, adeno-associated viruses, herpes viruses, or bovine papilloma viruses, may be used for delivery and expression of such nucleotide sequences into the targeted cell population. Methods for the construction of such vectors and expression constructs are well known. See, for example, Sambrook et al., 1989, Molecular Cloning, A Laboratory Manual, Cold Spring Harbor Press, Cold Spring Harbor N.Y., and Ausubel et al., 1989, Current Protocols in Molecular Biology, Greene Publishing Associates and Wiley Interscience, NY.

Effective dosages of the peptides of the invention to be administered may be determined through procedures well known to those in the art which address such parameters as biological half-life, bioavailability, and toxicity. In particularly preferred embodiments, an effective hybrid polypeptide dosage range is determined by one skilled in the art using data from routine in vitro and in vivo studies well know to those skilled in the art. For example, in vitro cell culture assays of antiviral activity, such as the exemplary assays described in Section 7, below, for T1249, will provide data from which one skilled in the art may readily determine the mean inhibitory concentration (IC) of the peptide of the polypeptide necessary to block some amount of viral infectivity (e.g., 50%, $IC_{50}$; or 90%, $IC_{90}$) Appropriate doses can then be selected by one skilled in the art using is pharmacokinetic data from one or more routine animal models, such as the exemplary pharmacokinetic data described in Section 10, below, for T1249, so that a minimum plasma concentration ($C_{min}$) of the peptide is obtained which is equal to or exceeds the determined IC value.

Exemplary polypeptide dosages may be as low as 0.1 μg/kg body weight and as high as 10 mg/kg body weight. More preferably an effective dosage range is from 0.1–100 μg/kg body weight. Other exemplary dosages for peptides of the invention include 1–5 mg, 1–10 mg, 1–30 mg, 1–50 mg, 1–75 mg, 1–100 mg, 1–125 mg, 1–150 mg, 1–200 mg, or 1–250 mg of peptide. A therapeutically effective dose refers to that amount of the compound sufficient to result in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit large therapeutic indices are preferred. The data obtained from these cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the $IC_{50}$ (e.g., the concentration of the test compound which achieves a half-maximal inhibition of the fusogenic event, such as a half-maximal inhibition of viral infection relative to the amount of the event in the absence of the test compound) as determined in cell culture. Such information can be used to more accurately determine useful doses in humans. Levels in plasma may be measured, for example, by high performance liquid chromatography (HPLC) or any biological or immunological assay capable of measuring peptide levels.

The hybrid polypeptides of the invention can be administered in a single administration, intermittently, periodically, or continuously. For example, the polypeptides of the invention can be administered in a single administration, such as a single subcutaneous, a single intravenous infusion or a single ingestion. The polypeptides of the invention can also be administered in a plurality of intermittent administrations, including periodic administrations. For example, in certain embodiments the polypeptides of the invention can be administered once a week, once a day, twice a day (e.g., every 12 hours), every six hours, every four hours, every two hours, or every hour. The polypeptides of the invention may also be administered continuously, such as by a continuous subcutaneous or intravenous infusion pump or by means of a subcutaneous or other implant which allows the polypeptides to be continuously absorbed by the patient.

The hybrid polypeptides of the invention can also be administered in combination with at least one other therapeutic agent. Although not preferred for HIV therapy, administration for other types of therapy (e.g., cancer therapy) can be performed concomitantly or sequentially, including cycling therapy (that is, administration of a first compound for a period of time, followed by administration of a second antiviral compound for a period of time and repeating this sequential administration in order to reduce the development of resistance to one of the therapies).

In the case of viral, e.g., retroviral, infections, an effective amount of a hybrid polypeptide or a pharmaceutically acceptable derivative thereof can be administered in combination with at least one, preferably at least two, other antiviral agents.

Taking HIV infection as an example, such antiviral agents can include, but are not limited to DP-107 (T21), DP-178 (T20), any other core polypeptide depicted in Table 2 derived from HIV-1 or HIV-2, any other hybrid polypeptide whose core polypeptide is, at least in part, derived from HIV-1 or HIV-2, cytokines, e.g., rIFN α, rIFN β, rIFN γ; inhibitors of reverse transcriptase, including nucleoside and non-nucleoside inhibitors, e.g., AZT, 3TC, D4T, ddI, adefovir, abacavir and other dideoxynucleosides or dideoxyfluoronucleosides, or delaviridine mesylate, nevirapine, efavirenz; inhibitors of viral mRNA capping, such as ribavirin; inhibitors of HIV protease, such as ritonavir, nelfinavir mesylate, amprenavir, saquinavir, saquinavir mesylate, indinavir or ABT378, ABT538 or MK639; amphotericin B as a lipid-binding molecule with anti-HIV activity; and castanospermine as an inhibitor of glycoprotein processing.

The hybrid and/or core polypeptides of the invention may, further, be utilized prophylactically for the prevention of disease. Hybrid and/or core polypeptides can act directly to prevent disease or, alternatively, can be used as vaccines, wherein the host raises antibodies against the hybrid polypeptides of the invention, which then serve to neutralize pathogenic organisms including, for example, inhibiting viral, bacterial and parasitic infection.

For all such treatments described above, the exact formulation, route of administration and dosage can be chosen by the individual physician in view of the patient's condition. (See e.g. Fingl et al., 1975, in "The Pharmacological Basis of Therapeutics", Ch. 1 p. 1).

It should be noted that the attending physician would know how to and when to terminate, interrupt, or adjust administration due to toxicity, or to organ dysfunctions. Conversely, the attending physician would also know to adjust treatment to higher levels if the clinical response were not adequate (precluding toxicity). The magnitude of an administrated dose in the management of the oncogenic disorder of interest will vary with the severity of the condition to be treated and the route of administration. The dose and perhaps dose frequency, will also vary according to the age, body weight, and response of the individual patient. A program comparable to that discussed above may be used in veterinary medicine.

Use of pharmaceutically acceptable carriers to formulate the compounds herein disclosed for the practice of the invention into dosages suitable for systemic administration is within the scope of the invention. With proper choice of carrier and suitable manufacturing practice, the compositions of the present invention, in particular, those formulated as solutions, may be administered parenterally, such as by subcutaneous injection, intravenous injection, by subcutaneous infusion or intravenous infusion, for example by pump. The compounds can be formulated readily using pharmaceutically acceptable carriers well known in the art into dosages suitable for oral administration. Such carriers enable the compounds of the invention to be formulated as tablets, pills, capsules, liquids, gels, syrups, slurries, suspensions and the like, for oral ingestion by a patient to be treated.

Pharmaceutical compositions suitable for use in the present invention include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of the active compounds into preparations which can be used pharmaceutically. The preparations formulated for oral administration may be in the form of tablets, dragees, capsules, or solutions. For oral administration of peptides, techniques such of those utilized by, e.g., Emisphere Technologies well known to those of skill in the art and can routinely be used.

The pharmaceutical compositions of the present invention may be manufactured in a manner that is itself known, e.g., by means of conventional mixing, dissolving, granulating, dragee-making, levigating, spray drying, emulsifying, encapsulating, entrapping or lyophilizing processes.

Pharmaceutical formulations for parenteral administration include aqueous solutions of the active compounds in water-soluble form. Additionally, emulsions and suspensions of the active compounds may be prepared as appropriate oily injection mixtures. Suitable lipophilic solvents or vehicles include fatty oils such as sesame oil, or synthetic fatty acid esters, such as ethyl oleate or triglycerides, liposomes or other substances known in the art for making lipid or lipophilic emulsions. Aqueous injection suspensions may contain substances which increase the viscosity of the suspension, such as sodium carboxymethyl cellulose, sorbitol, or dextran. optionally, the suspension may also contain suitable stabilizers or agents which increase the solubility of the compounds to allow for the preparation of highly concentrated solutions.

Pharmaceutical preparations for oral use can be obtained by combining the active compounds with solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, trehalose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added.

In instances where an enhancement of the host immune response is desired, the hybrid polypeptides may be formulated with a suitable adjuvant in order to enhance the immunological response. Such adjuvants may include, but are not limited to mineral gels such as aluminum hydroxide; surface active substances such as lysolecithin, pluronic polyols, polyanions; other peptides; oil emulsions; and potentially useful adjuvants such as BCG and Corynebacterium parvum. Many methods may be used to introduce the vaccine formulations described here. These methods include but are not limited to oral, intradermal, intramuscular, intraperitoneal, intravenous, subcutaneous, and intranasal routes.

6. EXAMPLE: IDENTIFICATION OF CONSENSUS AMINO ACID SEQUENCES THAT COMPRISE ENHANCER PEPTIDE SEQUENCES

The retroviral gp41 protein contains structural domains referred to as the α-helix region located in the C-terminal region of the protein and the leucine zipper region located in the N-terminal region of the protein. Alignment of the enhancer peptide sequence regions contained within gp41 (FIGS. 2A and 2B) derived from all currently published isolate sequences of HIV-1, HIV-2 and SIV served to identify the consensus amino acid sequences shown in FIG. 1.

As described in detail in the Examples presented below, such sequences represent enhancer peptide sequences in that linkage of these peptide sequences to a variety of different core polypeptides enhances the pharmacokinetic properties of the resultant hybrid polypeptides.

7. EXAMPLE: HYBRID POLYPEPTIDES THAT FUNCTION AS POTENT INHIBITORS OF HIV-1 INFECTION

T1249, as depicted in FIG. 13B, is a hybrid polypeptide comprising enhancer peptide sequences linked to an HIV core polypeptide. As demonstrated below, the T1249 hybrid polypeptide exhibits enhanced pharmacokinetic properties and potent in vitro activity against HIV-1, HIV-2, and SIV isolates, with enhanced activity against HIV-1 clinical isolates in HuPBMC infectivity assays in vitro as well as in the HuPBMC SCID mouse model of HIV-1 infection in vivo. In the biological assays described below, the activity of T1249 is compared to the potent anti-viral T20 polypeptide. The T20 polypeptide, also known as DP-178, is derived from the HIV-1 gp41 protein sequence, and is disclosed and claimed in U.S. Pat. No. 5,464,933.

7.1. MATERIALS AND METHODS

7.1.1. PEPTIDE SYNTHESIS AND PURIFICATION

Peptides were synthesized using Fast Moc chemistry. Generally, unless otherwise noted, the peptides contained amidated carboxyl termini and acetylated amino termini. Purification was carried out by reverse phase HPLC.

T1249 (Ac-WQEWEQKITALLEQAQIQQEKNEYELQ KLDKWASLWEWF-NH$_2$) (SEQ ID NO:1071) is a 39 amino acid peptide (MW=5036.7) composed entirely of naturally occurring amino acids and is blocked at the amino terminus by an acetyl group and the carboxyl terminus is blocked by an amido group to enhance stability. T1387 is a 23 amino acid peptide lacking enhancer peptide sequences (Ac-TALLEQAQIQQEKNEYELQKLDK-NH$_2$) (SEQ ID NO:1205). Thus, T1387 represents the core polypeptide of the T1249 hybrid polypeptide. T1387 is blocked at its amino- and carboxy- termini in the same manner as T1249.

In particular, T1249 was synthesized using standard solid-phase synthesis techniques. The identity of the principal peak in the HPLC trace was confirmed by mass spectroscopy to be T1249.

T1249 was readily purified by reverse phase chromatography on a 6-inch column packed with a C18, 10 micron, 120A support.

7.1.2. VIRUS

The HIV-1$_{LAI}$ virus (Popovic, M. et al., 1984, Science 224:497–508) was propagated in CEM cells cultured in RPMI 1640 containing 10% fetal calf serum. Supernatant from the infected CEM cells was passed through a 0.2 $\mu$m filter and the infectious titer estimated in a microinfectivity assay using the AA5 cell line to support virus replication. For this purpose, 20 $\mu$l of serially diluted virus was added to 20 $\mu$l CEM cells at a concentration of 6×10$^5$/ml in a 96-well microtitre plate. Each virus dilution was tested in triplicate. Cells were cultured for seven days by addition of fresh medium every other day. On day 7 post infection, supernatant samples were tested for virus replication as evidenced by reverse transcriptase activity released to the supernatant. The TCID$_{50}$ was calculated according to the Reed and Muench formula (Reed, L. J. et al., 1938, Am. J. Hyg. 27:493–497).

7.1.3. CELL FUSION ASSAY

Approximately 7×10$^4$ Molt-4 cells were incubated with 1×10$^4$ CEM cells chronically infected with the HIV-1$_{LAI}$ virus in 96-well tissue culture plates in a final volume of 100 $\mu$l culture medium (RPM1 1640 containing 10% heat inactivated FBS, supplemented with 1% L-glutamine and 1% Pen-Strep) as previously described (Matthews, T. J. et al., 1987, Proc. Natl. Acad. Sci. USA 84: 5424–5428). Peptide inhibitors were added in a volume of 10 $\mu$l and the cell mixtures were incubated for 24 hr. at 37° C. in 5% CO$_2$. At that time, multinucleated giant cells (syncytia, five cell widths or larger) were counted by microscopic examination at 10× and 40× magnification which allowed visualization of the entire well in a single field. Treated cells were compared to infected, untreated controls and results expressed as percent inhibition of infected controls.

7.1.4. MAGI-CCR-5 INFECTIVITY ASSAYS

Approximately 1×106 Magi-CCR-5 cells (obtained through the NIH AIDS Research and Reference Reagent Program, Division of AIDS, NIAID; Chackerian, B. et al., 1997, J. Virol. 71: 3932–3939) were seeded into a 48-well tissue culture plate (approximately 2×10$^4$ cells/well in a volume of 300 $\mu$l/well selective growth medium consisting of DMEM supplemented with 10% heat inactivated FBS, 1% L-glutamine, 1% Pen/Strep, Hygromycin B, Geneticin, and Puromycin) and allowed to attach overnight at 37° C., 5% CO$_2$. Cell confluency was approximately 30% by the following day. Seeding medium was removed and diluted peptide inhibitor added in volumes of 50 $\mu$l/well (media only in untreated controls), followed by 100 $\mu$l/well of diluted virus (desired input virus titre of 100–200 pfu/well). Finally, 250 $\mu$l of selective growth medium was added to each well and the plate incubated for 2 days at 37° C., 5% Co$_2$. Fixing and staining were done according to the protocol provided by NIAID with the MAGI-CCR5 cells. Briefly, medium was removed from the plate and 500 $\mu$l of fixative added to each well. Plates were allowed to fix for 5 minutes at room temp. Fixative was removed, each well washed twice with DPBS, and 200 $\mu$l of staining solution added to each well. The plate was then incubated at 37° C., 5% CO$_2$, for 50 minutes, staining solution removed, and each well washed twice with DPBS. The plate was allowed to air dry before blue cells were counted by microscopic, enumerating the entire well. Treated wells were compared to infected, untreated controls and results expressed as percent inhibition of infected controls.

7.1.5. REVERSE TRANSCRIPTASE ASSAY

The micro-reverse transcriptase (RT) assay was adapted from Goff et al. (Goff, S. et al., 1981, J. Virol. 38: 239–248) and Willey et al. (Willey, R. et al., 1988, J. Virol. 62: 139–147). Supernatants from virus/cell cultures were adjusted to 1% Triton-X100. 10 $\mu$l of each supernatant/Triton X-100 sample were added to 50 $\mu$l of RT cocktail (75 mM KCl, 2 mM Clevelands reagent, 5 mM MgCl$_2$, 5 $\mu$g/ml poly A, 0.25 units/ml oligo dT, 0.05% NP40, 50 mM Tris-HCl, pH 7.8, 0.5 $\mu$M non-radioactive dTTP, and 10 cCi/ml $^{32}$P-dTTP) in a 96-well U-bottom microtitre plate and incubated at 37° C. for 90 min. After incubation, 40 $\mu$l of reaction mixture from each well was transferred to a Schleicher and Schuell (S+S) dot blot apparatus, under partial vacuum, containing a gridded 96-well filter-mat (Wallac catalog #1450–423) and filter backing saturated with 2×SSC buffer (0.3M NaCl and 0.003M sodium citrate). Each well was washed 4 times with at least 200 $\mu$l 2×SSC using full vacuum. Minifold was disassembled and gridded filter paper removed and washed 3 times with 2×SSC. Finally, the filter membrane was drained on absorbent paper, allowed to air dry, and sealed in heat sealable bags. Samples were placed in a phosphorscreen cassette and an erased (at least 8 min) phosphorscreen applied and closed. Exposure was for 16 hr. Pixel Index Values (PIV), generated in volume reporting format retrieved from phosphorimaging (Molecular Dynamics Phosphorimager) blots, were used to determine the affected or inhibited fraction (Fa) for all doses of inhibitor(s) when compared to untreated, infected controls (analyzed by ImageQuant volume report, corrected for background).

7.1.6. HUMAN PBMC INFECTIVITY/ NEUTRALIZATION ASSAY

The prototypic assay used cell lines where the primary isolate assay utilizes PBMC, obtained through Interstate Blood Bank, activated for 2–3 days with a combination of OKT3 (0.5 μg/ml) and CD28 antibodies (0.1 μg/ml). The target cells were banded on lymphocyte separation medium (LSM), washed, and frozen. Cells were thawed as required and activated as indicated above a minimum of 2–3 days prior to assay. In this 96-well format assay, cells were at a concentration of $2 \times 10^6$/ml in 5% IL-2 medium and a final volume of 100 μl. Peptide stock solutions were made in DPBS (1 mg/ml). Peptide dilutions were performed in 20% FBS RPM1 1640/5% IL-2 complete medium.

7.1.7. IN VIVO HU-PBMC SCID MODEL OF HIV-1 INFECTION

Female SCID mice (5–7 weeks old) received $5-10 \times 10^7$ adult human PBMC injected intraperitoneally. Two weeks after reconstitution, mice were infected IP on day 0 with $10^3$ $TCID_{50}$ HIV-1 9320 (AZT-sensitive isolate A018). Treatment with peptides was IP, bid, beginning day −1 and continuing through day 6. The extent of infection in blood cells, splenocytes, lymph nodes, and peritoneal cells was assayed by quantitative co-culture with human PBMC blasts weekly for three consecutive weeks following animal exsanguinations and tissue harvest (day 7, approximately 12–18 hours following the last drug treatment). Co-culture supernatants were evaluated for HIV-1 p24 antigen production as a measure of virus infection (Immunotek Coulter kits and protocol).

7.1.8. RAT PHARMACOKINETIC STUDIES

250–300 g male CD rats, double jugular catheter, obtained from Charles River Laboratories were used. Peptides were injected in one jugular catheter in a volume of 200 μl of peptide solution (approximately 3.75 mg/ml), dosing solution concentration was determined using the Edelhoch method, (Edelhoch, 1967, Biochemistry 6:1948–1954) method and adjusted based on animal weight such that each animal received a dose of 2.5 mg/kg). Approximately 250–300 μl of blood was removed at predetermined time intervals (0, 15, 30 min and 1, 2, 4, 6, and 8 hours) and added to EDTA capiject tubes. Plasma was removed from pelleted cells upon centrifugation and either frozen or immediately processed for fluorescence HPLC analysis.

7.1.9. FLUORESCENCE HPLC ANALYSIS OF PLASMA SAMPLES

100 μl of sample plasma was added to 900 μl of precipitation buffer (acetonitrile, 1.0% TFA, detergent) resulting in precipitation of the majority of plasma proteins. Following centrifugation at 10,000 rpm for 10 min, 400 μl of the supernatant was removed and added to 600 μl of HPLC grade water. Serial dilutions were performed as dictated by concentration of peptide present in each sample in dilution buffer comprised of 40% precipitation buffer and 60% HPLC water. In addition to sample dilutions, serial dilutions of dosing solution were performed in buffer as well as in plasma and used to generate a standard curve relating peak area to known concentration of peptide. This curve was then used to calculate concentration of peptide in plasma taking into account all dilutions performed and quantity injected onto column.

7.1.10. XTT PROTOCOL

In order to measure cytotoxic/cytostatic effects of peptides, XTT assays (Weislow, O. S. et al., 1989, J. Natl. Cancer Inst. 81:577–586) were performed in the presence of varying concentrations of peptide in order to effectively establish a selective index (SI). A $TC_{50}$ was determined in this assay by incubating cells in the presence and absence of serially diluted peptide followed by the addition of XTT. In surviving/metabolizing cells XTT is reduced to a soluble brown dye, XTT-formazan. Absorbance is read and comparisons made between readings in the presence and absence of peptide to determine a $TC_{50}$ utilizing the Karber method (see. e.g., Lennette, E. H. et al., eds., 1969, "Diagnostic Procedures for Viral and Rickettsial Infections," American Public Health Association, Inc., fourth ed., pp. 47–52). Molt 4, CEM (80,000 cells/well) and a combination of the two cell types (70,000 and 10,000 respectively) were plated and incubated with serially diluted peptide for 24 hours in a total volume of 100 μl. Following incubation, 25 μl of XTT working stock (1 mg/ml XTT, 250 μM PMS in complete medium containing 5% DMSO) was added to each well and the plates incubated at 37° C. Color development was read and results used to express values generated from peptide containing wells as a percentage of the untreated control wells.

7.2. RESULTS

7.2.1. ANTIVIRAL ACTIVITY—FUSION ASSAYS

T1249 was directly compared to T20 in virus mediated cell-cell fusion assays conducted using chronically infected CEM cells mixed with uninfected Molt-4 cells, as shown in Table 3, below. T1249 fusion inhibition against lab isolates such as IIIb, MN, and RF is comparable to T20, and displays an approximately 2.5–5-fold improvement over T20. T1249 was also more active (3–28 fold improvement) than T20 against several syncytia-inducing clinical isolates, including an AZT resistant isolate (G691-2), a pre-AZT treatment isolate (G762-3), and 9320 (isolate used in HuPBMC-SCID studies). Most notably, T1249 was over 800-fold more potent than T20 against HIV-2 NIHZ.

TABLE 3

| Virus Isolate | T20 (ng/ml) | n | T1249 (ng/ml) | n | Fold Difference |
|---|---|---|---|---|---|
| HIV-1 IIIb | 2.5 | 9 | 1.0 | 9 | 2.5 |
| HIV-1 G691-2 (AZT-R) | 406.0 | 1 | 16.0 | 1 | 25 |
| HIV-1 G762-3 (Pre-AZT) | 340.1 | 1 | 12.2 | 1 | 28 |
| HIV-1 MN | 20.0 | 7 | 3.1 | 7 | 6 |
| HIV-1 RF | 6.1 | 7 | 2.1 | 7 | 3 |
| HIV-1 9320 | 118.4 | 1 | 34.5 | 1 | 3 |
| HIV-2 NIHZ | 3610.0 | >10 | 4.3 | 2 | 840 |

7.2.2. ANTIVIRAL ACTIVITY—Magi-CCR-5 INFECTIVITY ASSAYS

Magi-CCR-5 infectivity assays allow direct comparisons to be made of syncytia and non-syncytia inducing virus isolates, as well as comparisons between laboratory and clinical isolates. The assay is also a direct measure of virus infection (TAT expression following infection, transactivating an LTR driven beta-galactosidase production), as opposed to commonly used indirect measures of infectivity such as p24 antigen or reverse transcriptase production. Magi-CCR-5 infectivity assays (see Table 4 below) reveal that T1249 is consistently more effective than T20 against all isolates tested, in terms of both $EC_{50}$ and Vn/Vo=0.1 inhibition calculations. T1249 shows considerable improvement in potency against the clinical isolate HIV-1 301714 (>25-fold), which is one of the least sensitive isolates to T20. In addition, T1249 is at least 100-fold more potent than T20 against the SIV isolate B670. These data, along with fusion data suggest that T1249 is a potent peptide inhibitor of HIV-1, HIV-2, and SIV.

TABLE 4

| Virus Isolate | EC-50 | T20 Vn/Vo = 0.1 | EC-50 | T1249 Vn/Vo = 0.1 | EC-50 Difference | Vn/Vo = 0.1 Fold Difference |
|---|---|---|---|---|---|---|
| HIV-1 IIIB | 42 | 80 | 8 | 10 | 5 | 8 |
| HIV-1 9320 | 11 | 50 | 1 | 6 | 11 | 8 |
| HIV-1 301714 (subtype B, NSI) | 1065 | 4000 | 43 | 105 | 25 | 38 |
| HIV-1 G691-2 (AZT-R) | 13 | 200 | 0.3 | 20 | 43 | 10 |
| HIV-1 pNL4-3 | 166 | 210 | 1 | 13 | 166 | 16 |
| SIV-B670 | 2313 | >10000 | 21 | 100 | 110 | >100 |

7.2.3. ANTIVIRAL ACTIVITY—HuPBMC INFECTIVITY ASSAYS

T1249 was directly compared to T20 in HuPBMC infectivity assays (Table 5, below), which represent a recognized surrogate in vitro system to predict plasma drug concentrations required for viral inhibition in vivo. These comparisons revealed that T1249 is more potent against all HIV-1 isolates tested to date, with all Vn/Vo=0.1 (dose required to reduce virus titer by one log) values being reduced to sub-microgram concentrations. Many of the least sensitive clinical isolates to T20 exhibited 10-fold or greater sensitivity to T1249. It is noteworthy that HIV-1 9320, the isolate used in the HuPBMC SCID mouse model of infection, is 46-fold less sensitive to T20 than to T1249, indicating a very good correlation with the in vivo results.

TABLE 5

| Virus Isolate (HIV-1) | T20 Vn/Vo = 0.1 (ng/ml) | T1249 Vn/Vo = 0.1 (ng/ml) | Fold Difference |
|---|---|---|---|
| IIIB | 250 | 80 | 3 |
| 9320 | 6000 | 130 | 46 |
| 301714 (subtype B, NSI) | 8000 | 700 | 11 |
| 302056 (subtype B, NSI) | 800 | 90 | 9 |
| 301593 (subtype B, SI) | 3500 | 200 | 18 |
| 302077 (subtype A) | 3300 | 230 | 14 |
| 302143 (SI) | 1600 | 220 | 7 |
| G691-2 (AZT-R) | 1300 | 400 | 3 |

7.2.4. ANTIVIRAL ACTIVITY—T20 RESISTANT LAB ISOLATES

T1249 was directly compared to T20 in virus mediated cell-cell fusion assays conducted using chronically infected CEM cells mixed with uninfected Molt-4 cells (Table 6, below). T1249 was nearly 200-fold more potent than T20 against a T20-resistant isolate.

TABLE 6

| Virus Isolate | T20 (ng/ml) | n | T1249 (ng/ml) | n | Fold Difference |
|---|---|---|---|---|---|
| HIV-1 pNL4-3 SM (T20 Resistant) | 405.3 | 3 | 2.1 | 3 | 193 |

In Magi-CCR-5 assays (see Table 7, below), T1249 is as much as 50,000-fold more potent than T20 against T20-resistant isolates such as pNL4-3 SM and pNL4-3 STM (Rimsky, L. and Matthews, T., 1998, J. Virol. 72:986–993).

TABLE 7

| Virus Isolate (HIV-1) | EC-50 | T20 Vn/Vo = 0.1 | EC-50 | T1249 Vn/Vo = 0.1 | EC-50 Fold Difference | Vn/Vo = 0.1 Fold Difference |
|---|---|---|---|---|---|---|
| pNL4-3 | 166 | 210 | 1 | 13 | 166 | 16 |
| pNL4-3 SM (T20-R) | 90 | 900 | 4 | 11 | 23 | 82 |
| pNL4-3 SM (T20-R) Duke | 410 | 2600 | 4 | 11 | 103 | 236 |
| pNL4-3 STM (T20/T649-R) | >50000 | >50000 | 1 | 13 | >50000 | >3846 |

T1249 was directly compared to T20 in HuPBMC infectivity assays (see Table 8, below), evaluating differences in potency against a resistant isolate. T1249 is greater than 250-fold more potent than T20 against the resistant isolate pNL4-3 SM.

TABLE 8

| Virus Isolate (HIV-1) | T20 Vn/VO = 0.1 (ng/ml) | T1249 Vn/Vo = 0.1 (ng/ml) | Fold Difference |
|---|---|---|---|
| pNL4-3 | 3500 | 30 | 117 |
| pNL4-3 SM (T20-R) | >10000 | 40 | >250 |

7.2.5. ANTIVIRAL ACTIVITY—IN VIVO SCID-HuPBMC MODEL

In vivo antiviral activity of T1249 was directly compared to T20 activity in the HuPBMC-SCID mouse model of HIV-1 9320 infection (FIG. 3). Two weeks after reconstitution with HuPBMCs, mice were infected IP on day 0 with $10^3$ $TCID_{50}$ HIV-1 9320 passed in PBMCs (AZT-sensitive isolate A018). Treatment with peptides was IP, bid, for total daily doses of 67 mg/kg (T20), 20 mg/kg (T1249), 6.7 mg/kg (T1249), 2.0 mg/kg (T1249), and 0.67 mg/kg (T1249), for 8 days beginning on day −1. The extent of infection in blood cells, splenocytes, lymph nodes, and peritoneal cells was assayed by quantitative co-culture with human PBMC blasts weekly for three consecutive weeks following animal exsanguinations and tissue harvest (day 7, approx. 12 to 18 hours following last drug treatment). Co-culture supernatants were evaluated for HIV-1 p24 antigen production as a measure of virus infection. Infectious virus was not detectable in the blood or lymph tissues of the T20-treated animals, although, virus was detected in the peritoneal washes and spleen preparation. All compartments were negative for infectious virus at the 6.7 mg/kg dose of T1249, indicating at least a 10-fold improvement over T20 treatment. At the 2.0 mg/kg dose of T1249, both the lymph and the spleen were completely free of detectable infectious virus, with a 2 $\log_{10}$ reduction in virus titer in the peritoneal wash and a 1 $\log_{10}$ reduction in virus titer in the blood, compared to infected controls. At the lowest dose of T1249, 0.67 mg/kg, the peritoneal washes and blood were equivalent to infected control; however, at least a 1 $\log_{10}$ drop in infectious virus titer was observed in both the lymph and the spleen tissues. Overall, the results indicate that T1249 is between 30 and 100-fold more potent against HIV-1 9320, in vivo, under these conditions.

7.2.6. PHARMACOKINETIC STUDIES—RAT

Figure 4A:
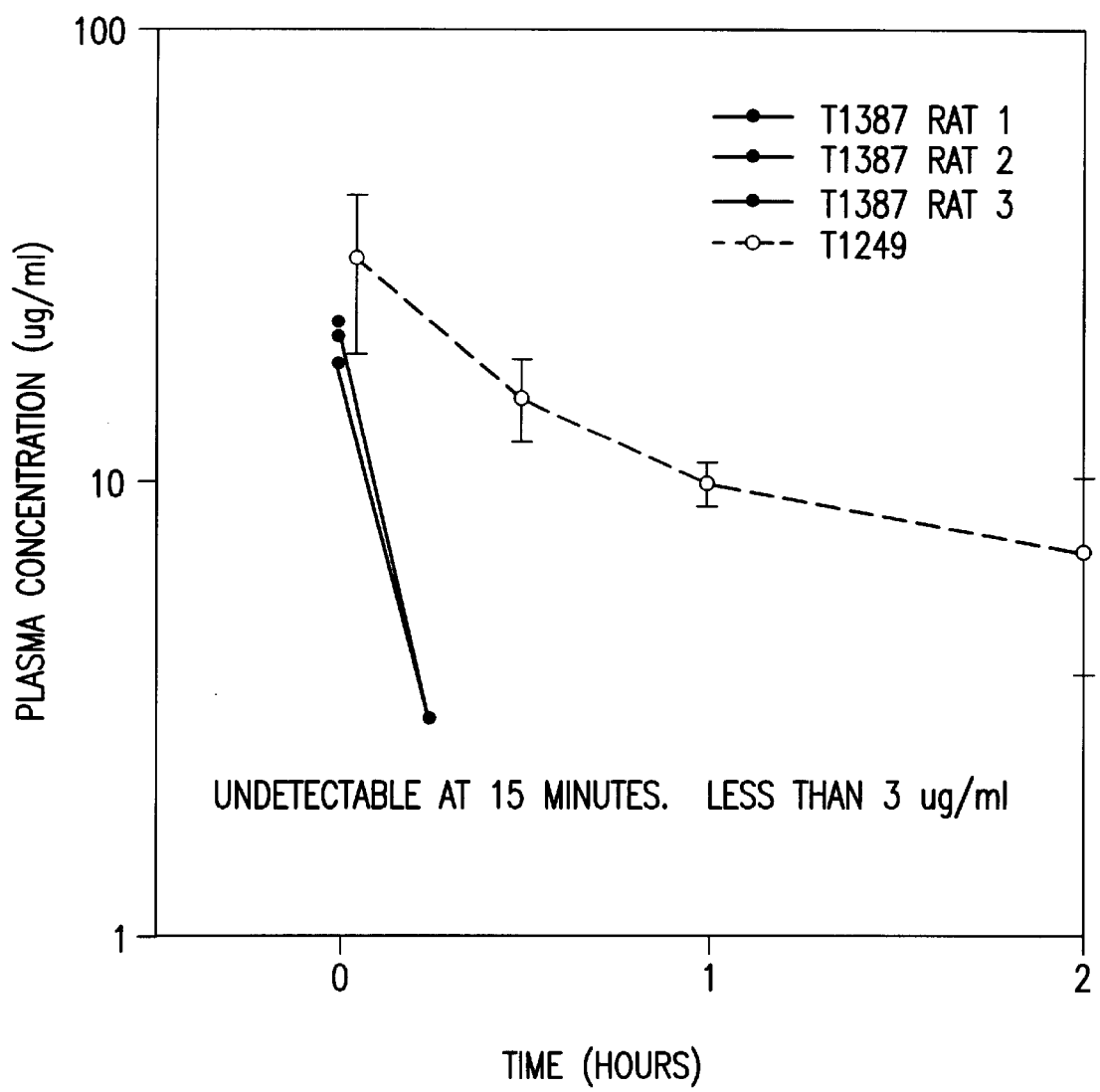
Figure 4B:
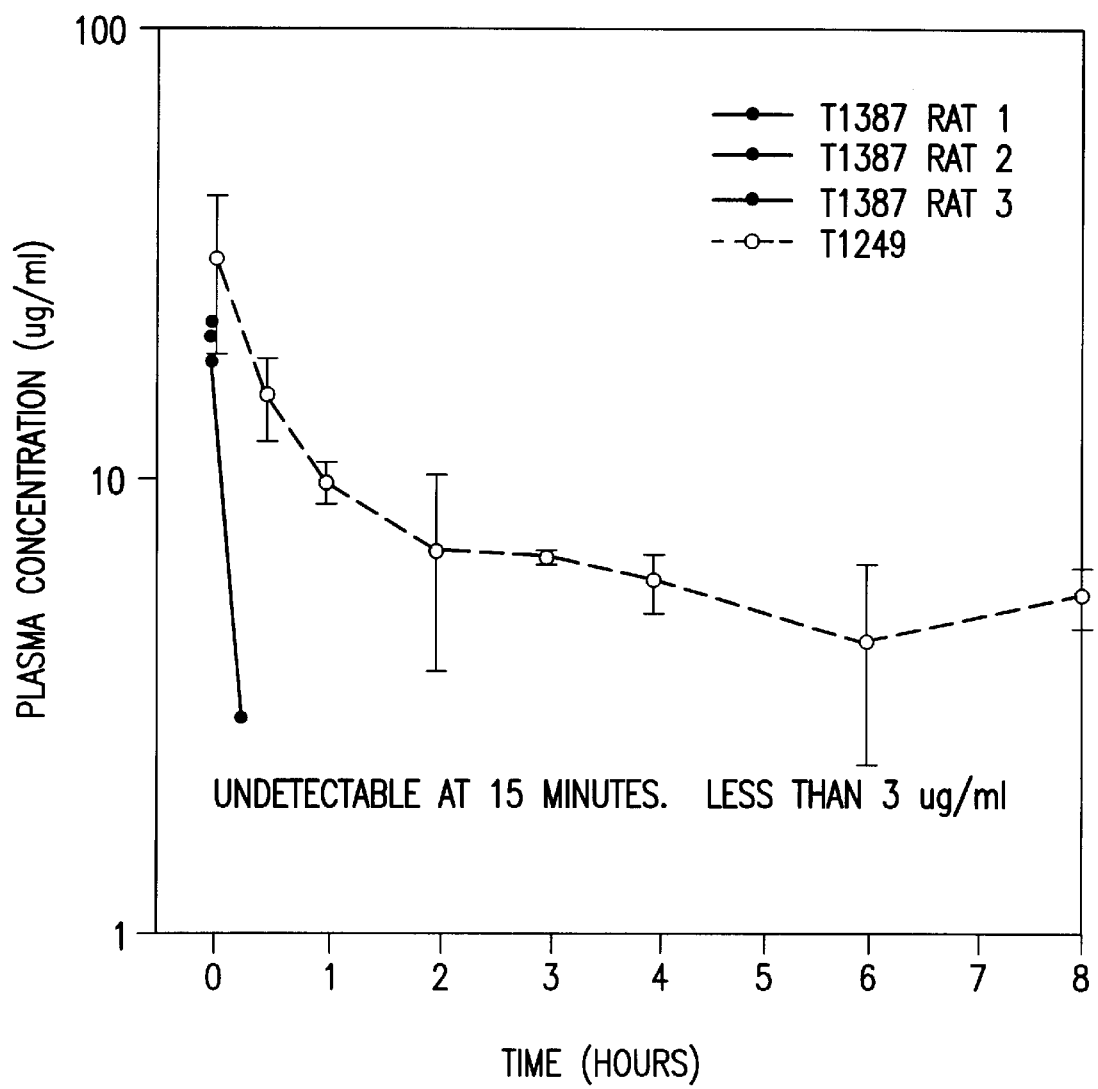
Figure 5:
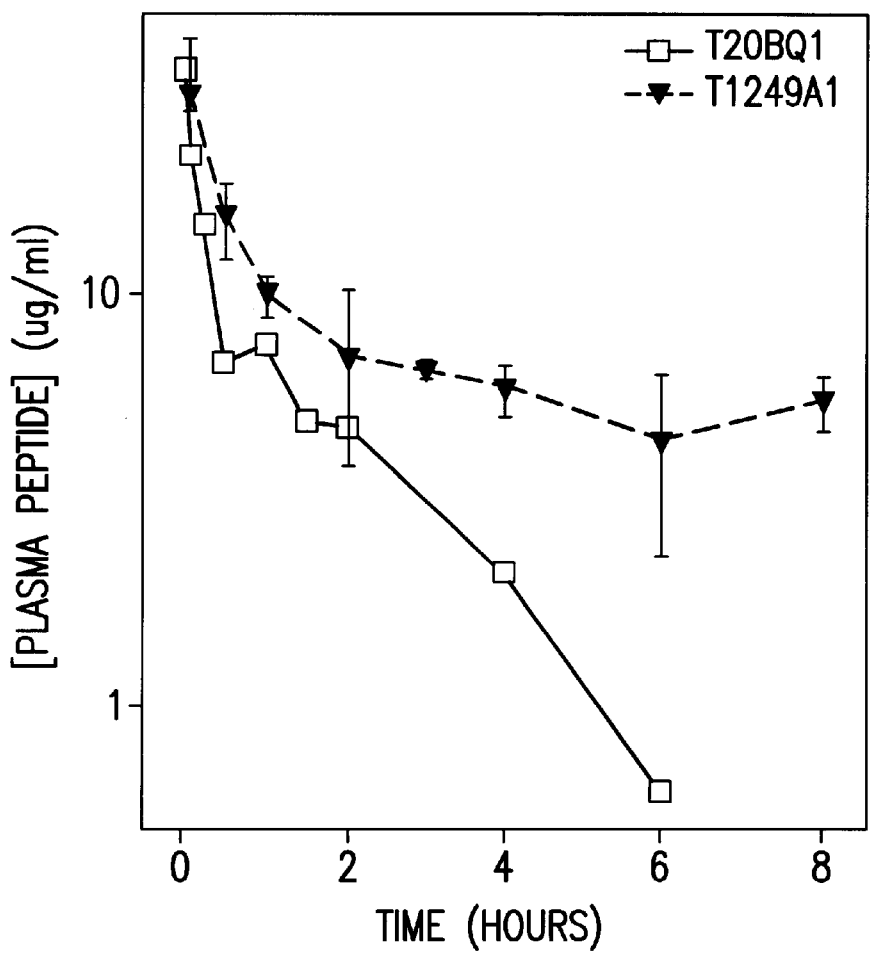

Cannulated rats were used to further define the pharmacokinetic profile of T1249. Male CD rats, 250–300 g, were dosed IV through a jugular catheter with T1249 and T20 (FIGS. 4A–5). The resulting plasma samples were evaluated using fluorescence HPLC to estimate peptide quantities in extracted plasma. The beta-phase half-life and total AUC of T1249 was nearly three times greater than T20 (FIG. 5).

7.2.7. CYTOTOXICITY

Figure 6:
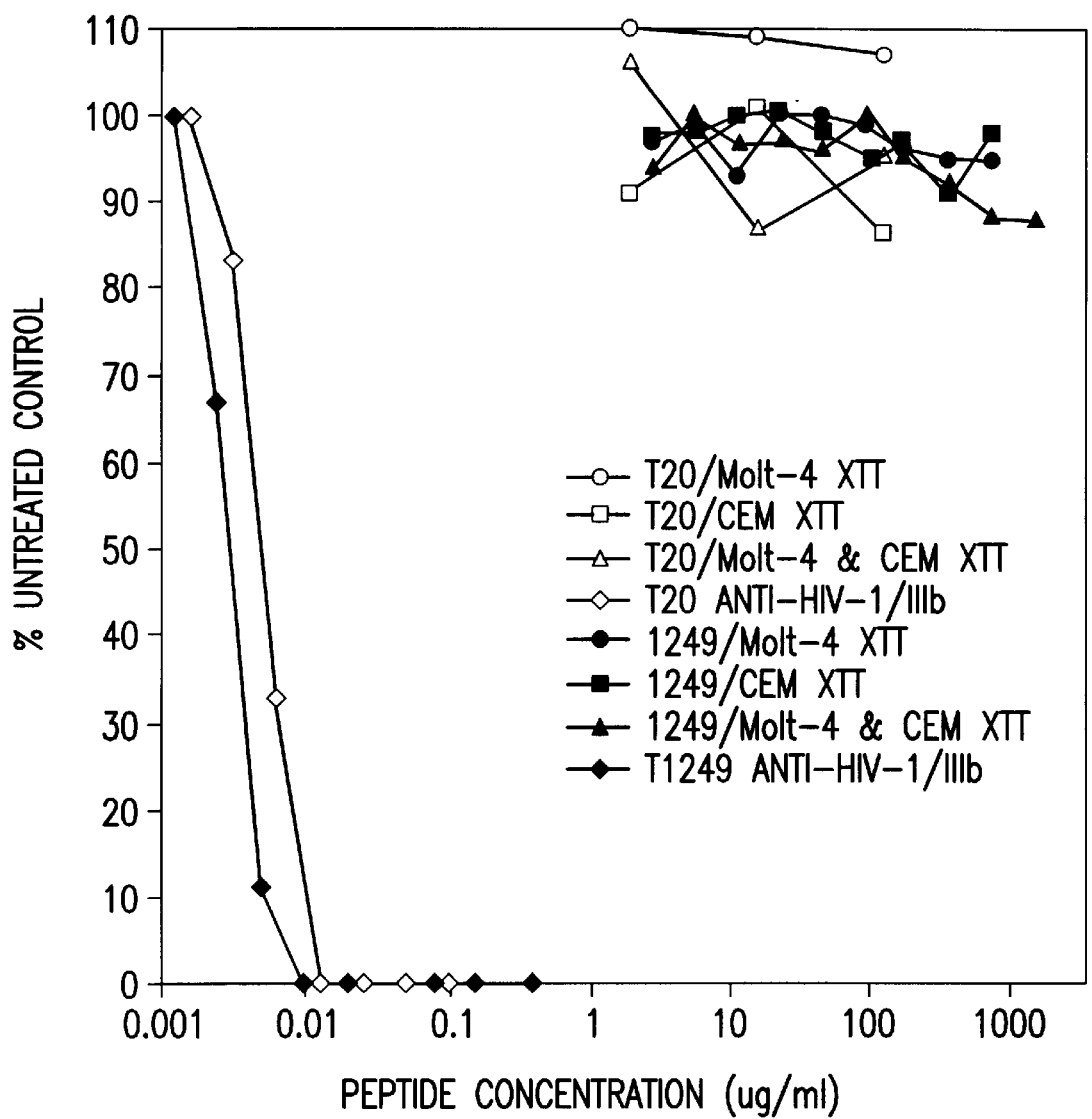

No overt evidence of T1249 cytotoxicity has been observed in vitro, as demonstrated in FIG. 6.

In addition, T1249 is not acutely toxic (death within 24 hours) at 167 mg/kg (highest dose tested) given IV through jugular cannula (0.3 ml over 2–3 min).

7.2.8. DIRECT BINDING TO gp41 CONSTRUCT M41Δ178

Figure 7B:
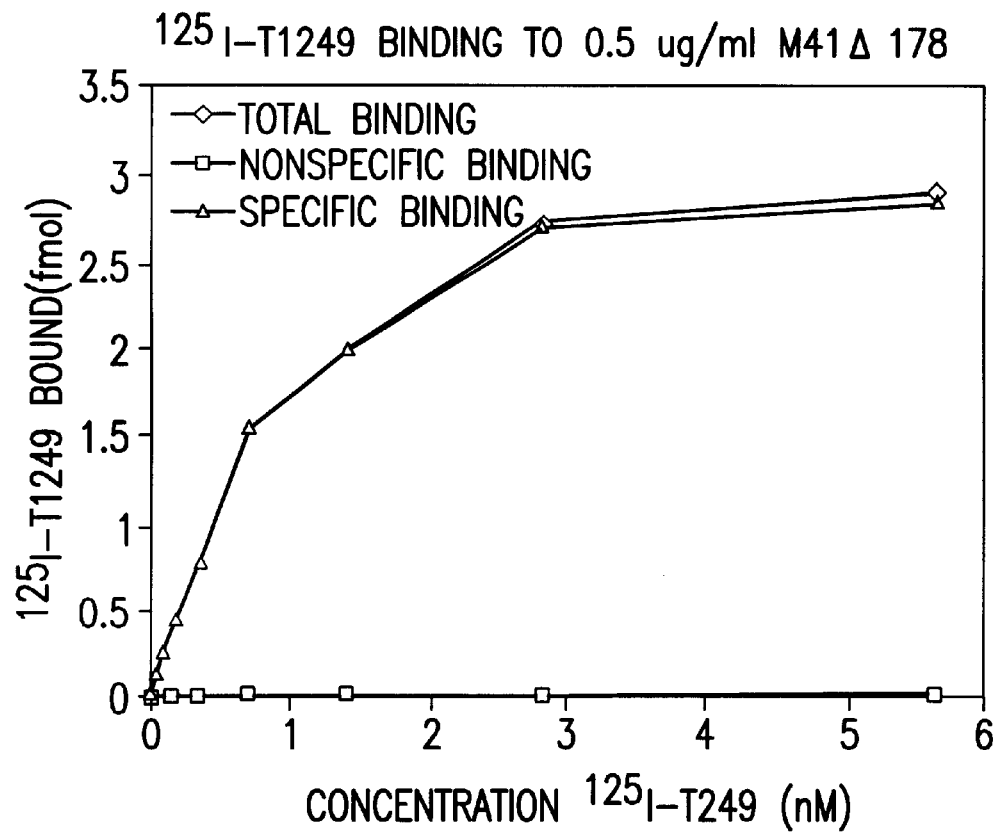
Figures 1, 7B:
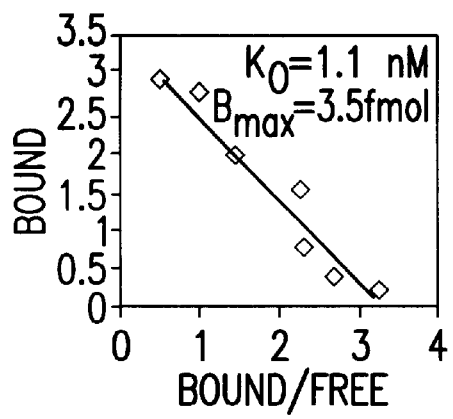

T1249 was radiolabelled with $^{125}$I and HPLC-purified to maximum specific activity. T20 was iodinated in the same manner. Saturation binding of T20 and T1249 to M41Δ178 (a truncated gp41 ectodomain fusion protein lacking the T20 amino acid sequence) immobilized on microtitre plates at 0.5 μg/ml is shown in FIGS. 7A–7B. Nonspecific binding was defined as binding of the radioligand in the presence of 1 μM unlabeled peptide. Specific binding was the difference between total and nonspecific binding. The results demonstrate that $^{125}$I-T1249 and $^{125}$I-T20 have similar binding affinities of 1–2 nM. Linear inverse Scatchard plots suggest that each ligand binds to a homogeneous class of sites.

The kinetics of $^{125}$I-T1249 and $^{125}$I-T20 binding were determined on scintillating microtitre plates coated with 0.5 μg/ml M41Δ178. The time course for association and dissociation is shown in FIGS. 8A–8B. Dissociation of bound radioligand was measured following the addition of unlabeled peptide to a final concentration of 10 μM in one-tenth of the total assay volume. Initial on- and off-rates for $^{125}$I-T1249 were significantly slower than those of $^{125}$I-T20. Dissociation patterns for both radioligands were unchanged when dissociation was initiated with the other unlabeled peptide (i.e., $^{125}$I-T1249 with T20).

To further demonstrate that both ligands compete for the same target site, unlabeled T1249 and T20 were titrated in the presence of a single concentration of either $^{125}$I-T1249 or $^{125}$I-T20. Ligand was added just after the unlabeled peptide to start the incubation. The competition curves shown in FIGS. 9A–9B suggest that although both ligands have similar affinities, a higher concentration of either unlabeled T20 or T1249 is required to fully compete for bound $^{125}$I-T1249.

7.2.9. DIRECT BINDING TO THE HR1 REGION OF GP41

Circular dichroism (CD) spectroscopy was used to measure the secondary structure of T1249 in solution (phosphate-buffered saline, pH 7) alone and in combination with a 45-residue peptide (T1346) from the HR1 (heptad repeat 1) binding region of gp 41. FIG. 14A illustrates the CD spectrum of T1249 alone in solution (10 μM, 1° C.). The spectrum is typical of peptides which adopt an alpha-helical structure. In particular, deconvolution of this spectrum using single value decomposition with a basis set of 33 protein spectra predicts the helix content of T1249 (alone in solution) to be 50%. FIG. 14B illustrates a representative CD spectrum of T1249 mixed with T1346. The closed squares (■) represent a theoretical CD spectrum predicted for a "non-interaction model" wherein the peptides are hypothesized to not interact in solution. The actual experimental spectrum (●) differs markedly from this theoretical "non-interaction model" spectrum, demonstrating that the two peptides do, indeed, interact, producing a measurable structural change which is observed in the CD spectrum.

7.2.10. PROTEASE PROTECTION OF THE T1249 BINDING REGION WITHIN GP41

The susceptibility of the chimeric protein M41Δ178, described in Section 7.2.8 above, to proteinase-K digestion was determined and analyzed by polyacrylamide gel electrophoresis. The results are illustrated in FIG. 15.

When either M41Δ178 (untreated; FIG. 15, lane 2) or T1249 (untreated; FIG. 15, lane 4) are incubated individually with proteinase K (FIG. 15, lanes 3 and 5, respectively), both are digested. However, when T1249 is incubated with M41Δ178 prior to addition of proteinase-K (FIG. 15, lane 7), a protected HR-1 fragment of approximately 6500 Daltons results. Sequencing of the protected fragment demonstrates that it corresponds to a region of primary sequence located within the ectodomain of gp41. The protected fragment encompasses the soluble HR1 peptide (T1346) used in the CD studies described in Section 7.2.9 above, and further contains an additional seven amino acid residues located on the amino terminus. This protection can be attributed to the binding of T1249 to a specific sequence of gp41 which is contained in the M41Δ178 construct.

8. EXAMPLE: RESPIRATORY SYNCYTIAL VIRUS HYBRID POLYPEPTIDES

The following example describes respiratory syncytial virus (RSV) hybrid polypeptides with enhanced pharmacokinetic properties. In addition, results are presented, below, which demonstrate that the RSV hybrid polypeptides represent potent inhibitors of RSV infection.

8.1. MATERIALS AND METHODS

8.1.1. PEPTIDE-SYNTHESIS AND PURIFICATION

RSV polypeptides were synthesized using standard Fast Moc chemistry. Generally, unless otherwise noted, the peptides contained amidated carboxyl termini and acetylated amino termini. Purification was carried out by reverse phase HPLC.

8.1.2. RESPIRATORY SYNCYTIAL VIRUS PLAQUE REDUCTION ASSAY

All necessary dilutions of peptides were performed in clean, sterile 96-well TC plate. A total of eleven dilutions for each peptide and one control well containing no peptide were assembled. The final concentration range of peptide started at 50 µg/ml or 100 µg/ml, with a total of eleven two-fold dilutions. The RSV was prepared at a concentration of 100PFU/well in 100 µl 3% EMEM, as determined by a known titer of RSV. The virus is then added to all of the wells.

The media was removed from one sub-confluent 96-well plate of Hep2 cells. The material from the dilution plate was transferred onto the cell plates starting with row 1 and then transferring row 12, row 11, etc. until all rows were transferred. Plates were placed back into the incubator for 48 hours.

The cells were checked to ensure that syncytia were present in the control wells. Media was removed and approximately 50 µls of 0.25% Crystal Violet in methanol was added to each well. The wells were rinsed immediately in water to remove excess stain and allowed to dry. Using a dissecting microscope, the number of syncytia in each well was counted.

8.2. RESULTS

Pharmacokinetic studies with the RSV hybrid peptides T1301 (Ac-WQEWDEYDASISQVNEKINOALAYI READELWA WF-NH$_2$) (SEQ ID NO:1122) and T1302 (Ac-WQAWDEYDASISQVNEKINQALAYIREADEL WAWF-NH$_2$) (SEQ ID NO:1123) containing enhancer peptide sequences demonstrated a greatly enhanced half-life relative to core peptide T786 (Ac-VYPSDEYDA SISQVNEEINQALAYIRKADELLENV-NH$_2$) (SEQ ID NO:6692), as demonstrated in FIGS. 10A–10B. Hybrid polypeptides T1301, T1302 and T1303 (Ac-WQAWD EYDASISDVNEKINQALAYIREADELWEWF-NH$_2$) (SEQ ID NO:1124) also showed a greatly enhanced half-life relative to core peptide T1476 (Ac-DEYDASISQV NEKINQALAYIREADEL-NH$_2$) (SEQ ID NO:1416).

RSV hybrid polypeptides T1301, T1302 and T1303, as well as polypeptides T786 and T1293, were tested for their ability to inhibit RSV plaque formation of HEp2 cells. As indicated in FIGS. 11A and 11B, both of the tested hybrid RSV polypeptides, as well as the T786 core polypeptide were able to inhibit RSV infection. Surprisingly, the T1293 hybrid polypeptide was also revealed to be a potent anti-RSV compound (FIG. 13C).

9. EXAMPLE: LUTEINIZING HORMONE HYBRID POLYPEPTIDES

The example presented herein describes luteinizing hormone (LH) hybrid proteins with enhanced pharmacokinetic properties. The following LH hybrid peptides were synthesized and purified.using the methods described above: core peptide T1323 (Ac-QHWSYGLRPG-NH$_2$) (SEQ ID NO:1143) and hybrid polypeptide T1324 (Ac-WQEWEQKIQHWSYGLRPGWASLWEWF-NH$_2$) (SEQ ID NO:1144) which comprises the core polypeptide T1323 amino acid sequence coupled with enhancer peptides at its amino- and carboxy-termini. As demonstrated in FIGS. 12A and 12B, the T1324 hybrid peptide exhibited a significantly increased half-life when compared to the T1323 core peptide which lacks the enhancer peptide sequences.

10. EXAMPLE: PHARMACOLOGY OF HYBRID POLYPEPTIDE T1249

T1249, depicted in FIG. 13B, is a hybrid polypeptide comprising enhancer peptide sequences linked to a core polypeptide derived from a mix of viral sequences. As demonstrated in the Example presented in Section 7 above, the T1249 hybrid polypeptide exhibits enhanced pharmacokinetic properties and potent in vitro as well as in vivo activity against HIV-1. In the example presented below, the pharmacological properties of T1249 in both rodent and primate animal models are further described.

10.1. MATERIALS AND METHODS

10.1.1. SINGLE-DOSE ADMINISTRATION TO RODENTS

T1249 was administered to Sprague-Dawley albino rats in a single dose administered by continuous subcutaneous infusion (SCI), subcutaneous (SC) injection or intravenous (IV) injection. Each treatment group consisted of nine rats per sex per group. The groups received sterile preparations of T1249 bulk drug substance at a dose of 0.5, 2.0, or 6.5 mg/kg by CSI. One group received 50 mM carbonate-bicarbonate, pH 8.5, administered as a control. The peptides were given for 12 hours via a polyvinyl chloride/polyethylene catheter surgically implanted subcutaneously in the nape of the neck. Two groups received a single dose of T1249 at a dose of 1.2 or 1.5 mg/kg by subcutaneous injection into the intrascapular region. Two groups received a single dose of T1249 at a dose of 1.5 or 5 mg/kg via intravenous injection. The actual milligram amount of T1249 was calculated using the peptide content that was determined for the batch administrated.

Endpoints for analysis included cageside observations (twice daily for mortality and moribundity), clinical observations, clinical laboratory parameters, body weight and necropsy. Blood samples were obtained by a sparse sampling technique over a 12 hour time period from three rats per sex per group at each of the following times: 0.5, 1, 2, 4, 6, 8, 19, and 12 hours after dose administration. Sample analysis was performed using a PcAb ECLIA assay (Blackburn, G. et al., 1991, Clin. Chem. 37:1534–1539; Deaver, D., 1995, Nature 377:758).

For plasma and lymphatic pharmacokinetic analysis of T1249 in rats, T1249 was prepared as a sterile solution in bicarbonate buffer and administered as a single dose, bolus intravenous injection into the lateral tail vain at a dose of mg/kg. Blood was collected from the animal from an in-dwelling jugular catheter. Samples were collected immediately after dosing and at 5, 15, and 30 minutes, and 1, 2, 4, and 6 hours after drug administration. For the analysis of lymphatic fluids, samples were taken immediately before dosing and every 20 minutes for the first six hours after dosing. Lymphatic fluid was collected from a catheter placed directly into the thoracic lymphatic duct as previously described (Kirkpatrick and Silver, 1970, *The Journal of Surgical Research* 10:147–158). The concentrations of T1249 in plasma and lymphatic fluid were determined using a standard T1249 Competitive ELISA assay (Hamilton, G. 1991, p. 139, in "Immunochemistry of Solid-Phase Immunoassay,", Butler, J., ed., CRC Press, Boston).

10.1.2. SINGLE-DOSE ADMINISTRATION TO PRIMATES

Sterile preparations of T1249 bulk drug substance were administered to cynomolgus monkeys in single doses administered by subcutaneous (SC), intramuscular (IM) or intravenous (IV) injection. In a sequential crossover design, one group of animals consisting of two per sex received a single bolus dose of T1249 by IV (0.8 mg/kg), IM (0.8 mg/kg) or SC (0.4, 0.8, and 1.6 mg/kg) injection. A washout period of at least three days separated each dosing day. Lyophilized T1249 was reconstituted in sterile phosphate buffered saline pH 7.4 immediately prior to dosing. The actual milligram amount of test article was calculated using the peptide content that was determined for the batch administered.

Endpoints for analysis included cageside observations, physical examinations and body weight. For the IV phase of the study, blood samples were collected into heparinized tubes at the following time points: immediately after dosing, 0.25, 0.5, 1.5, 3, 6, 12, and 24 hours after dosing. For the IM and SC phases of the study blood samples were collected in heparinized tubes from each animal at the following time points: 0.5, 1, 2, 3, 6, 12, and 24 hours after dosing. Plasma samples were prepared within one hour of collection and flash frozen in liquid nitrogen. Samples analysis was performed using a PcAb ECLIA assay (Blackburn, G. et al., 1991, Clin. Chem. 37:1534–1539; Deaver, D., 1995, Nature 377:758).

10.1.3. BRIDGING PHARMACOKINETIC STUDY

Six male cynomolgus monkeys were randomly assigned to three groups consisting of two animals per group. All doses of T1249 were given by bolus subcutaneous injection. The study was divided into two sessions. In Session 1, animals in groups 1, 2 and 3 received a sterile preparation of T1249 bulk drug substance (i.e., bulk T1249 dissolved in carbonate-bicarbonate, pH 8.5) twice daily for four consecutive days (Study Days 1–4) at doses of 0.2, 0.6 and 2.0 mg/kg/dose, respectively. A ten day washout period separated Session 1 and Session 2. In Session 2, animals in groups 1, 2, and 3 received a sterile preparation of T1249 drug product (i.e., in aqueous solution, pH 6.5, plus mannitol) twice daily for four consecutive days (Study Days 15–18) at doses of 0.2, 0.6 and 2.0 mg/kg/dose, respectively.

Blood samples for pharmacokinetic analyses were collected on Study Days 1 and 15 to assess single-dose pharmacokinetic parameters, and on Study Days 4 and 18 to assess steady-state plasma pharmacokinetic parameters. Samples were collected at the following times: immediately pre-dose, and 0.5, 1.5, 3.0, 4.0, 6.0, 8.0 and 12.0 hours post-dose. Animals were monitored during Sessions 1 and 2 for clinical signs and changes in body weight.

10.2. RESULTS

10.2.1. PHARMACOKINETICS OF T1249 ADMINISTERED TO RATS

Rat models were used to perform an initial assessment of plasma pharmacokinetics and distribution of T1249. For animals in all dose groups, there were no changes in body weight, physical observations, hematology and clinical chemistry parameters or macroscopic pathology observations related to the administration of T1249.

Rats that received T1249 by CSI achieved steady-state plasma peptide concentrations approximately four hours after administration. Both the steady-state concentration in plasma ($Cp_{ss}$) and calculated area under the plasma concentration versus time curve (AUC) were directly proportional to the administered dose, indicating that T1249 displays linear pharmacokinetics within the tested dose range of 0.5 to 6.5 mg/kg. Both the calculated pharmacokinetic parameters and the plasma concentration versus time curves for the CSI route of administration are presented in Table 9 and in FIG. 16A, respectively.

TABLE 9

| Parameter | Dose Groups | | |
|---|---|---|---|
| | 0.5 mg/kg | 2.0 mg/kg | 6.5 mg/kg |
| $Cp_{66}$ ($\mu g/ml$) | 0.80 | 2.80 | 10.9 |
| $AUC_{(0-12h)}$ ($\mu g \cdot h/ml$) | 7.99 | 25.9 | 120 |

Administration of T1249 by bolus IV injection resulted in linear dose-dependent pharmacokinetics within the doses tested. In contrast, exposure to T1249 by SC injection was not dose-dependent within the dose range studied. The calculated pharmacokinetic parameters and plasma concentration versus time curves for both SC and IV administration of T1249 are shown in Table 10 and FIG. 16B respectively.

TABLE 10

| Parameter | Dose Groups/Administration | | | |
|---|---|---|---|---|
| | (SC) | | (IV) | |
| | 1.2 mg/kg | 15 mg/kg | 1.5 mg/kg | 5.0 mg/kg |
| $t_{1/2, terminal}$ (hours) | 2.02 | 2.00 | 2.46 | 1.86 |
| $t_{max}$ (hours) | 1.09 | 1.88 | — | — |
| $C_{max}$ ($\mu g/ml$) | 6.37 | 21.5 | 15.7 | 46.3 |
| $AUC_{(0-12h)}$ ($\mu g \cdot h/ml$) | 27.0 | 107 | 45.6 | 118 |
| $AUC_{(0-\infty)}$ ($\mu g \cdot h/ml$) | 27.6 | 110 | 47.1 | 120 |

The bioavailability of T1249 administered to rats by subcutaneously was determined relative to IV administration. The results are shown in Table 11 below. At low dose (1.2 mg/kg) T1249 exhibited a relative bioavailability ($F_R$) of 73% for subcutaneous administration. Relative bioavailability was 30% when high-dose (15 mg/kg) administration of T1249 concentration was greater than the concentration that inhibits 90% ($IC_{90}$) of HIV infectivity for the full 12 hours of the study at all doses examined.

TABLE 11

| Route | Dose (mg/kg) | $AUC_{(0-\infty)}$ ($\mu g \cdot h/ml$) | Normalized $AUC_{(0-28)}$ ($\mu g \cdot h/ml$) | $F_R$ (%) |
|---|---|---|---|---|
| Low Dose | | | | |
| SC | 1.2 | 27.6 | 34.5[a] | 73 |
| IV | 1.5 | 47.1 | — | — |
| High Dose | | | | |
| SC | 15 | 110 | 36.5[b] | 30 |
| IV | 5 | 120 | — | — |

[a] Normalized from a 1.2 mg/kg dose to a 1.5 mg/kg dose by multiplying $AUC_{(0-\infty)}$ by 1.25.
[b] Normalized from a 15 mg/kg dose to a 5 mg/kg dose by dividing $AUC_{(0-\infty)}$ by 3.

The kinetic data for both plasma and lymph concentrations of T1249 are illustrated in FIG. 16C and tabulated below in Table 12. T1249 rapidly penetrated into the lymphatic system and equilibrated with the plasma reservoir of drug within approximately one hour after administration. Following equilibration between the two compartments, plasma and lymph levels of drug were comparable out to three hours post-dosing in four out of five animals. One animal had consistently lower concentrations of T1249 in the lymph than the other animals, however this animal's lymph elimination profile was indistinguishable from other members of the group. Comparison of the elimination phase half-life (t1/2) for plasma and lymph suggest that the transit of T1249 between these two compartments is a diffusion-controlled process. After three hours, there appeared to be a second, more rapid elimination phase from the lymphatic system. This difference could be mechanism-based (e.g., due to redistribution or accelerated peptide degradation in the lymph) or due to other factors. The concentration of T1249 in lymphatic fluid six hours post-injection is greater than the $IC_{90}$ for viral infectivity for common laboratory strains and for primary clinical isolates of HIV-1.

The extent of penetration of T1249 into cerebrospinal fluid (CSF) was also assessed. T1249 concentrations were below the limit of detection (LOD; 2.0 ng T1249/ml CSF) at all measurable time points, indicating that T1249 does not penetrate the central nervous system after a single dose administration.

TABLE 12

| Parameter | T1249 | |
|---|---|---|
| | Plasma | Lymph |
| $t_{1/2}$, elimination (hours) | 2.6 ± 0.41 | 1.3 ± 0.27 |
| $C_{max}$ (μg/ml) | 291 | 133[a]/155[b] |
| $AUC_{(0-6h)}$ (μg · h/ml) | 506 | 348[a]/411[b] |
| $AUC_{(0-\infty)}$ (μg · h/ml) | 598 | 390[a]/449[b] |
| Cl (ml/h) | 7.8 | 11.5 |

[a]Calculated averages include one animal (Rat #1) that exhibited significantly lower lymph concentrations but a similar kinetic profile by comparison to the other animals in the group.
[b]Calculated averages that exclude Rat #1.

10.2.2. PHARMACOKINETICS OF T1249 ADMINISTERED TO PRIMATES

Primate models were used to evaluate the relationship between dose level and various pharmacokinetic parameters associated with the parenteral administration of T1249. Plasma concentrations greater than 6.0 μg/ml of T1249 were achieved by all routes of administration and quantifiable levels (i.e., levels greater than 0.5 μg/ml) were detected at 24 hours after SC and IV administration. The elimination $t_{1/2}$ was comparable for all routes of administration (5.4 hours, 4.8 hours and 5.6 hours for IV, SC and IM administration, respectively). Plasma concentrations of T1249 that exceed the $IC_{90}$ values for laboratory strains and clinical isolates of HIV-1 were observed at all measured time points throughout the 24 hour sampling period.

A comparison of the data obtained for the parenteral administration of 0.8 mg/kg T1249 via all routes of administration (SC, IV, and IM) is presented in FIG. 17A. FIG. 17B illustrates a comparison of the data obtained from SC injection at three different dose levels of T1249 (0.4 mg/kg, 0.8 mg/kg, and 1.6 mg/kg). FIG. 17B–1 contains a plot of the calculated AUC versus administered dose.

T1249 displays linear pharmacokinetics in cynomolgus monkeys following SC administration within the range of administered doses, indicating that saturation of the clearance mechanism or mechanisms has not occurred within this range. A summary of the pharmacokinetic data following parenteral administration of T1249 to cynomolgus monkeys is provided in Table 13, below. A comparison of the plasma AUC values indicates that, relative to intravenous administration, the bioavailability of T1249 is approximately 64% when given by intramuscular injection and 92% when given by subcutaneous injection.

TABLE 13

| | Administration Route (Dose Level, mg/kg) | | | | |
|---|---|---|---|---|---|
| Parameter | SC (0.4) | SC (0.8) | SC (1.6) | IM (0.8) | IV (0.8) |
| $t_{1/2,terminal}$ (h) | 6.23 ± 0.52 | 4.83 ± 0.48 | 5.55 ± 0.92 | 5.57 ± 0.24 | 5.35 ± 0.95 |
| $t_{max}$ (h) | 3.97 ± 1.18 | 4.58 ± 1.45 | 4.72 ± 1.81 | 2.32 ± 0.43 | — |
| $C_{max}$ (μg/ml) | 3.17 ± 0.09 | 6.85 ± 1.01 | 13.3 ± 2.55 | 6.37 ± 1.69 | 26.7 ± 0.25 |
| $AUC_{(0-24)}$ (μg · h/ml) | 37.5 ± 6.6 | 8.12 ± 11.4 | 168 ± 34.0 | 56.4 ± 12.3 | 87.4 ± 25.0 |
| $AUC_{(0-\infty)}$ (μg · h/ml) | 40.9 ± 8.2 | 85.3 ± 13.6 | 181 ± 44.0 | 59.5 ± 13.1 | 92.5 ± 25.0 |
| $F_R$ (%) | — | 92.3 | — | 64.4 | — |

10.2.3. BRIDGING PHARMACOKINETIC STUDY

Bridging pharmacokinetic studies were performed in order to compare the plasma pharmacokinetic profiles of the T1249 bulk drug substances used in the nonclinical trials described above to the formulated T1249 drug product which would be administered to an actual subject or patient, e.g., to treat HIV infection. The study was designed as a parallel group, one-way, cross-over comparison of three dose levels of T1249 bulk drug substance and three dose levels of formulated drug product. Plasma pharmacokinetics were assessed after single-dose administration and after steady state was achieved.

Administration of T1249 by subcutaneous injection resulted in measurable levels of peptide in all dose groups. The plasma concentration-time curves were roughly parallel within all dose groups following the initial dose (Days 1 and 15) and at steady state (Days 4 and 18) for both T1249 bulk drug substance and formulated T1249 drug product. Furthermore $AUC_{(0-12hr)}$ values varied in direct proportion to the dose level for both drug formulations. Calculated $AUC_{(0-12hr)}$ values for the drug product ranged from 43% to 80% of the $AUC_{(0-12hr)}$ values calculated for drug substance following single dose administration, and from 36% to 71% at steady state.

T1249 bulk drug substance and drug product demonstrated similar pharmacokinetic profiles in cynomolgus monkeys following bolus subcutaneous administration at the dose levels and dose volume tested. A direct comparison of the shapes of the plasma concentration-time curves in the present study and the shapes of curves from a previous study in cynomolgus monkeys suggests that there is a depot effect when T1249 is administered by subcutaneous injection. This is suggested by the increases in time at which maximal plasma concentration ($t_{max}$) is achieved and $t_{1/2}$.

These results indicate that the formulation of bulk drug substance used in the pharmacology program yields comparable AUC values and other kinetic parameters to those observed following the administration of the formulated drug product. These observations indicate that clinical administration of T1249 will result in total patient exposure to T1249.

11. EXAMPLE: ISOLATION OF A NOVEL CORE POLYPEPTIDES WITH ANTIVIRAL ACTIVITY FOR A T649 RESISTANT HIV-1 ISOLATE

Described herein, in one particular, but non-limiting example, a modified core peptide is generated that exhibits antiviral activity against HIV strains resistant to an unmodified, "parent" core peptide.

The peptide T649 shown in Table 2 is a peptide derived from a region of the HIV-1 gp41 protein referred to herein as HR2. In studies of HIV-1 variants resistant to T649, isolation and sequencing of the nucleic acid encoding the HR2 region of the resistant variants, gp41 peptide reveals a mutation that results in a single mutation within this region: a change from an asparagine (N) to a lysine (K) residue.

Using the result, a new polypeptide, referred to herein as DP397, was synthesized that contains the T649 amino acid sequence into which the above-noted N-to-K mutation has been introduced. The T649 and DP397 peptides are shown below, with the single amino acid difference between the two peptides depicted in bold:

T649: WMEWDREINNYTSLIHSLIEESQNQQEKN EQELL (SEQ ID NO:572)

DP397: WMEWDREINKYTSLIHSLIEESQNQQEKN EQELL (SEQ ID NO:1581)

It is noted that the difference between T649 and DP397 falls withing a potential N-glycosylation site (underlined). Thus, the mutation in the gp41 of the T649-resistant strains had abolished this potential N-glycosylation site.

The DP397 core polypeptide exhibits anti-viral activity against the HIV-1 variants that are resistant to the T649 peptide. In particular, the DP397 peptide exhibited markedly increased antiviral activity, as assayed by the Magi-CCR-5 infectivity assay described in Section 7.1.7, above, against four HIV-1 variants. Further, the DP397 peptide was also found, in certain experiments, to exhibit increased antiviral activities against these strains relative to the T1249 peptide.

FIGS. 18A–D show the number of infected cells exposed to T649 resistant variants as a function of the peptide concentration for T649, DP397, and T1249. Specifically, FIGS. 18A–B show data from experiments using the T649 resistant HIV-1 strains referred to herein as RF-649 and DH012-649, respectively. These strains derived from HIV-$1_{RF}$ and HIV-$1_{DH012}$ isolates, respectively, which were passed through cell cultures in the presence of T649 to produce T649 resistant variants.

FIGS. 18C–D show data from experiments using engineered T649 resistant HIV-1 strains referred to herein as 3'ETVQQQ and SIM-649, respectively. The strain 3'ETVQQQ was obtained from an HIV-1LAI clone that was molecularly mutagenized to contain the amino acid sequence ETVQQQ (SEQ ID NO:1669), in place of GIVQQQ (SEQ ID NO:9, residues 6–11) in the HR1 domain of the gp41 protein. HR1 is a region of the HIV-1 gp41protein to which the HR2 domain and the T649 peptide bind. The strain SIM-649 was obtained from an HIV-1LAI clone that was molecularly mutagenized to contain the amino acid sequence SIM, in place of GIV, in the HR1 domain of the gp41 protein, and subsequently passed through cell cultures in the presence of T649 to produce a T649 resistant variant.

The DP397 peptide exhibits markedly increased inhibition of HIV-1 infection compared to T649 for all four strains examined. Further, the DP397 peptide exhibits increased inhibition of HIV-1 infection compared to T1249 for the RF-649 strain (FIG. 18A) and, at higher concentrations, for the DH012–649 strain (FIG. 18B).

The present invention is not to be limited in scope by the specific embodiments described herein, which are intended as single illustrations of individual aspects of the invention, and functionally equivalent methods and components are within the scope of the invention. Indeed, various modifications of the invention, in addition to those shown and described herein will become apparent to those skilled in the art from the foregoing description and accompanying drawings. Such modifications are intended to fall within the scope of the appended claims.

SEQUENCE LISTING (1757 sequences)

SEQ ID NO: 1 - protein, 19 aa, Artificial Sequence
  Core polypeptide
GIKQLQARILAVERYLKDQ

SEQ ID NO: 2 - protein, 19 aa, Artificial Sequence
  Core polypeptide
NNLLRAIEAQQHLLQLTVW

SEQ ID NO: 3 - protein, 18 aa, Artificial Sequence
  Core polypeptide
NEQELLELDKWASLWNWF

SEQ ID NO: 4 - protein, 18 aa, Artificial Sequence
  Core polypeptide
YTSLIHSLIEESQNQQEK

SEQ ID NO: 5 - protein, 28 aa, Artificial Sequence
  Core polypeptide
VWGIKQLQARILAVERYLKDQQLLGIWG

SEQ ID NO: 6 - protein, 28 aa, Artificial Sequence
  Core polypeptide
QHLLQLTVWGIKQLQARILAVERYLKDQ

SEQ ID NO: 7 - protein, 28 aa, Artificial Sequence
  Core polypeptide
LRAIEAQQHLLQLTVWGIKQLQARILAV

SEQ ID NO: 8 - protein, 28 aa, Artificial Sequence
  Core polypeptide
VQQQNNLLARIEAQQHLLQLTVWGIKQL

SEQ ID NO: 9 - protein, 28 aa, Artificial Sequence
  Core polypeptide
RQLLSGIVQQQNNLLRAIEAQQHLLQLT

SEQ ID NO: 10 - protein, 28 aa, Artificial Sequence
  Core polypeptide
MTLTVQARQLLSGIVQQQNNLLRAIEAQ

SEQ ID NO: 11 - protein, 27 aa, Artificial Sequence
  Core polypeptide
VVSLSNGVSVLTSKVLDLKNYIDKQLL

SEQ ID NO: 12 - protein, 28 aa, Artificial Sequence
  Core polypeptide
LLSTNKAVVSLSNGVSVLTSKVLDLKNY

SEQ ID NO: 13 - protein, 28 aa, Artificial Sequence
  Core polypeptide
VLHLEGEVNKIKSALLSTNKAVVSLSNG

SEQ ID NO: 14 - protein, 28 aa, Artificial Sequence
  Core polypeptide
LLSTNKAVVSLSNGVSVLTSKVLDLKNY

SEQ ID NO: 15 - protein, 36 aa, Artificial Sequence
  Core polypeptide
YTSLIHSLIEESQNQQEKNEQELLELDKWASLWNWF

SEQ ID NO: 16 - protein, 38 aa, Artificial Sequence
  Core polypeptide
NNLLRAIEAQQHLLQLTVWGIKQLQARILAVERYLKDQ

SEQ ID NO: 17 - protein, 42 aa, Artificial Sequence
  Core polypeptide
IELSNIKENKCNGTDAKVKLIKQELDKYKNAVTELQLLMQST

SEQ ID NO: 18 - protein, 28 aa, Artificial Sequence
  Core polypeptide
IELSNIKENKCNGTDAKVKLIKQELDKY

SEQ ID NO: 19 - protein, 28 aa, Artificial Sequence
  Core polypeptide
ENKCNGTDAKVKLIKQELDKYKNAVTEL

SEQ ID NO: 20 - protein, 28 aa, Artificial Sequence
  Core polypeptide
DAKVKLIKQELDKYKNAVTELQLLMQST

SEQ ID NO: 21 - protein, 28 aa, Artificial Sequence
  Core polypeptide
CNGTDAKVKLIKQELDKYKNAVTELQLL

SEQ ID NO: 22 - protein, 35 aa, Artificial Sequence
  Core polypeptide
SNIKENKCNGTDAKVKLIKQELDKYKNAVTELQLL

SEQ ID NO: 23 - protein, 37 aa, Artificial Sequence
  Core polypeptide
ASGVAVSKVLHLEGEVNKIKSALLSTNKAVVSLSNGV

SEQ ID NO: 24 - protein, 35 aa, Artificial Sequence
  Core polypeptide
SGVAVSKVLHLEGEVNKIKSALLSTNKAVVSLSNG

SEQ ID NO: 25 - protein, 35 aa, Artificial Sequence
  Core polypeptide
VLHLEGEVNKIKSALLSTHKAVVSLSNGVSVLTSK

SEQ ID NO: 26 - protein, 36 aa, Artificial Sequence
  Core polypeptide
ARKLQRMKQLEDKVEELLSKNYHYLENEVARLKKLV

SEQ ID NO: 27 - protein, 34 aa, Artificial Sequence
  Core polypeptide
RMKQLEDKVEELLSKNYHYLENEVARLKKLVGER

SEQ ID NO: 28 - protein, 28 aa, Artificial Sequence
  Core polypeptide
VQQQNNLLRAIEAQQHLLQLTVWGIKQL

SEQ ID NO: 29 - protein, 28 aa, Artificial Sequence
  Core polypeptide
LRAIEAQQHLLQLTVWGIKQLQARILAV

SEQ ID NO: 30 - protein, 28 aa, Artificial Sequence
  Core polypeptide
QHLLQLTVWGIKQLQARILAVERYLKDQ

SEQ ID NO: 31 - protein, 28 aa, Artificial Sequence
  Core polypeptide
RQLLSGIVQQQNNLLRAIEAQQHLLQLT

SEQ ID NO: 32 - protein, 28 aa, Artificial Sequence
  Core polypeptide
MTLTVQARQLLSGIVQQQNNLLRAIEAQ

SEQ ID NO: 33 - protein, 28 aa, Artificial Sequence
  Core polypeptide
AKQARSDIEKLKEAIRDTNKAVQSVQSS

SEQ ID NO: 34 - protein, 35 aa, Artificial Sequence
  Core polypeptide
AAVALVEAKQARSDIEKLKEAIRDTNKAVQSVQSS

SEQ ID NO: 35 - protein, 35 aa, Artificial Sequence
  Core polypeptide
AKQARSDIEKLKEAIRDTNKAVQSVQSSIGNLIVA

SEQ ID NO: 36 - protein, 28 aa, Artificial Sequence
  Core polypeptide
GTIALGVATSAQITAAVALVEAKQARSD

SEQ ID NO: 37 - protein, 28 aa, Artificial Sequence
  Core polypeptide
ATSAQITAAVALVEAKQARSDIEKLKEA

SEQ ID NO: 38 - protein, 28 aa, Artificial Sequence
  Core polypeptide
AAVALVEAKQARSDIEKLKEAIRDTNKA

SEQ ID NO: 39 - protein, 35 aa, Artificial Sequence
  Core polypeptide
IDISIELNKAKSDLEESKEWIEKSNQELDSIGNWE

SEQ ID NO: 40 - protein, 28 aa, Artificial Sequence
  Core polypeptide
IEKLKEAIRDTNKAVQSVQSSIGNLIVA

SEQ ID NO: 41 - protein, 28 aa, Artificial Sequence
  Core polypeptide
IRDTNKAVQSVQSSIGNLIVAIKSVQDY

SEQ ID NO: 42 - protein, 28 aa, Artificial Sequence
  Core polypeptide
AVQSVQSSIGNLIVAIKSVQDYVNKEIV

SEQ ID NO: 43 - protein, 50 aa, Artificial Sequence
  Core polypeptide
QARQLLSGIVQQQNNLLRAIEAQQHLLQLTVWGIKQLARILAVERYLKDQ

SEQ ID NO: 44 - protein, 28 aa, Artificial Sequence
  Core polypeptide
QARQLLSGIVQQQNNLLRAIEAQQHLLQ

SEQ ID NO: 45 - protein, 48 aa, Artificial Sequence
  Core polypeptide
MTWMEMDREINNYTSLIGSLIEESQNQQEKNEQELLELDKWASLWNWF

SEQ ID NO: 46 - protein, 35 aa, Artificial Sequence
  Core polypeptide
WMEWDREINNYTSLIGSLIEESQNQQEKNEQELLE

SEQ ID NO: 47 - protein, 28 aa, Artificial Sequence
  Core polypeptide
INNYTSLIGSLIEESQNQQEKNEQELLE

SEQ ID NO: 48 - protein, 35 aa, Artificial Sequence
  Core polypeptide
INNYTSLIGSLIEESQNQQEKNEQELLELDKWASL

SEQ ID NO: 49 - protein, 33 aa, Artificial Sequence
  Core polypeptide
EWDREINNYTSLIGSLIEESQNQQEKNEQEGGC

SEQ ID NO: 50 - protein, 28 aa, Artificial Sequence
  Core polypeptide
QSRTLLAGIVQQQQQLLDVVKRQQELLR

SEQ ID NO: 51 - protein, 44 aa, Artificial Sequence
  Core polypeptide
NNDTWQEWERKVDFLEENITALLEEAQIQQEKNMYELQKLNSWD

SEQ ID NO: 52 - protein, 28 aa, Artificial Sequence
  Core polypeptide
WQEWERKVDFLEENITALLEEAQIQQEK

SEQ ID NO: 53 - protein, 28 aa, Artificial Sequence
  Core polypeptide
VDFLEENITALLEEAQIQQEKNMYELQK

SEQ ID NO: 54 - protein, 28 aa, Artificial Sequence
  Core polypeptide
ITALLEEAQIQQEKNMYELQKLNSWDVF

SEQ ID NO: 55 - protein, 36 aa, Artificial Sequence
  Core polypeptide
SSESFTLLEQWNNWKLQLAEQWLEQINEKHYLEDIS

SEQ ID NO: 56 - protein, 10 aa, Artificial Sequence
  Core polypeptide
DKWASLWNWF

SEQ ID NO: 57 - protein, 18 aa, Artificial Sequence
  Core polypeptide
NEQELLELDKWASLWNWF

SEQ ID NO: 58 - protein, 20 aa, Artificial Sequence
  Core polypeptide
EKNEQELLELDKWASLWNWF

SEQ ID NO: 59 - protein, 23 aa, Artificial Sequence
  Core polypeptide
NQQEKNEQELLELDKWASLWNWF

SEQ ID NO: 60 - protein, 26 aa, Artificial Sequence
  Core polypeptide
ESQNQQEKNEQELLELDKWASLWNWF

SEQ ID NO: 61 - protein, 33 aa, Artificial Sequence
  Core polypeptide
LIHSLIEESQNQQEKNEQELLELDKWASLWNWF

SEQ ID NO: 62 - protein, 28 aa, Artificial Sequence
  Core polypeptide
NDQKKLMSNNVQIVRQQSYSIMSIIKEE

SEQ ID NO: 63 - protein, 28 aa, Artificial Sequence
  Core polypeptide
DEFDASISQVNEKINQSLAFIRKSDELL

SEQ ID NO: 64 - protein, 27 aa, Artificial Sequence
  Core polypeptide
VSKGYSALRTGWYTSVITIELSNIKEN

SEQ ID NO: 65 - protein, 27 aa, Artificial Sequence
  Core polypeptide
VVSLSNGVSVLTSKVLDLKNYIDKQLL

SEQ ID NO: 66 - protein, 28 aa, Artificial Sequence
  Core polypeptide
VNKIKSALLSTNKAVVSLSNGVSVLTSK

SEQ ID NO: 67 - protein, 35 aa, Artificial Sequence
  Core polypeptide
PIINFYDPLVFPSDEFDASISQVNEKINQSLAFIR

SEQ ID NO: 68 - protein, 28 aa, Artificial Sequence
  Core polypeptide
NLVYAQLQFTYDTLRGYINRALAQIAEA

SEQ ID NO: 69 - protein, 31 aa, Artificial Sequence
  Core polypeptide
LNQVDLTETLERYQQRLNTYALVSKDASYRS

SEQ ID NO: 70 - protein, 27 aa, Artificial Sequence
  Core polypeptide
ELLVLKKAQLNRHSYLKDSDFLDAALD

SEQ ID NO: 71 - protein, 27 aa, Artificial Sequence
  Core polypeptide
LAEAGEESVTEDTEREDTEEEREDEEE

SEQ ID NO: 72 - protein, 35 aa, Artificial Sequence
  Core polypeptide
ALLAEAGEESVTEDTEREDTEEEREDEEEENEART

SEQ ID NO: 73 - protein, 35 aa, Artificial Sequence
  Core polypeptide
ETERSVDLVAALLAEAGEESVTEDTEREDTEEERE

SEQ ID NO: 74 - protein, 28 aa, Artificial Sequence
  Core polypeptide
EESVTEDTEREDTEEEREDEEEENEART

SEQ ID NO: 75 - protein, 28 aa, Artificial Sequence
  Core polypeptide
VDLVAALLAEAGEESVTEDTEREDTEEE

SEQ ID NO: 76 - protein, 25 aa, Artificial Sequence
  Core polypeptide
NSETERSVDLVAALLAEAGEESVTE

SEQ ID NO: 77 - protein, 28 aa, Artificial Sequence
  Core polypeptide
DISYAQLQFTYDVLKDYINDALRNIMDA

SEQ ID NO: 78 - protein, 30 aa, Artificial Sequence
  Core polypeptide
SNVFSKDEIMREYNSQKQHIRTLSAKVNDN

SEQ ID NO: 79 - protein, 35 aa, Artificial Sequence
  Core polypeptide
IDISIELNKAKSDLEEAKEWIKKANQKLDSIGNWH

SEQ ID NO: 80 - protein, 35 aa, Artificial Sequence
  Core polypeptide
IDISIELNKAKSDLEESKEWIKKANQKLDSIGNWH

SEQ ID NO: 81 - protein, 39 aa, Artificial Sequence
  Core polypeptide
YESTQKAFDGITNKVNSVIEKTNTQFEAVGKEFGNLEKR

SEQ ID NO: 82 - protein, 28 aa, Artificial Sequence
  Core polypeptide
DEYDASISQVNEKINQSLAFIRKSDELL

SEQ ID NO: 83 - protein, 38 aa, Artificial Sequence
  Core polypeptide
VLHQLNIQLKQYLETQERLLAGNRIAARQLLQIWKDVA

SEQ ID NO: 84 - protein, 38 aa, Artificial Sequence
  Core polypeptide
LWHEQLLNTAQRAGLQLQLINQALAVREKVLIRYDIQK

SEQ ID NO: 85 - protein, 35 aa, Artificial Sequence
  Core polypeptide
LLDNFESTWEQSKELWEQQEISIQNLHKSALQEYW

SEQ ID NO: 86 - protein, 36 aa, Artificial Sequence
  Core polypeptide
LSNLLQISNNSDEWLEALEIEHEKWKLTQWQSYEQF

SEQ ID NO: 87 - protein, 36 aa, Artificial Sequence
  Core polypeptide
KLEALEGKLEALEGKLEALEGKLEALEGKLEALEGK

SEQ ID NO: 88 - protein, 29 aa, Artificial Sequence
  Core polypeptide
ELRALRGELRALRGELRALRGELRALRGK

SEQ ID NO: 89 - protein, 36 aa, Artificial Sequence
  Core polypeptide
ELKAKELEGEGLAEGEEALKGLLEKAAKLEGLELLK

SEQ ID NO: 90 - protein, 33 aa, Artificial Sequence
  Core polypeptide
MEWDREINNYTSLIHSLIEESQNQQEKNEQELL

SEQ ID NO: 91 - protein, 36 aa, Artificial Sequence
  Core polypeptide
YTSLIHSLIEESQNQQEKNEQELLELDKWASLWNAF

SEQ ID NO: 92 - protein, 36 aa, Artificial Sequence
  Core polypeptide
YTSLIHSLIEESQNQQEKNEQELLELDKWASLANWF

SEQ ID NO: 93 - protein, 36 aa, Artificial Sequence
  Core polypeptide
YTSLIHSLIEESQNQQEKNQQELLELDKWASLWNWF

SEQ ID NO: 94 - protein, 36 aa, Artificial Sequence
  Core polypeptide
YTSLIHSLIEESQNQQEKNEQELLQLDKWASLWNWF

SEQ ID NO: 95 - protein, 36 aa, Artificial Sequence
  Core polypeptide
YTSLIHSLIEESQNQQEKNQQELLQLDKWASLWNWF

SEQ ID NO: 96 - protein, 33 aa, Artificial Sequence
  Core polypeptide
RMKQLEDKVEELLSKNYHLENEVARLKKLVGER

SEQ ID NO: 97 - protein, 28 aa, Artificial Sequence
  Core polypeptide
QQLLQLTVWGIKQLQARILAVERYLKNQ

SEQ ID NO: 98 - protein, 18 aa, Artificial Sequence
  Core polypeptide
NEQELLELDKWASLWNWF

SEQ ID NO: 99 - protein, 36 aa, Artificial Sequence
  Core polypeptide
YTSLIQSLIEESQNQQEKNEQELLELDKWASLWNWF

SEQ ID NO: 100 - protein, 35 aa, Artificial Sequence
  Core polypeptide
IINFYDPLVFPSDEFDASISQVNEKINQSLAFIRK

SEQ ID NO: 101 - protein, 35 aa, Artificial Sequence
  Core polypeptide
INFYDPLVFPSDEFDASISQVNEKINQSLAFIRKS

SEQ ID NO: 102 - protein, 35 aa, Artificial Sequence
  Core polypeptide
NFYDPLVFPSDEFDASISQVNEKINQSLAFIRKSD

SEQ ID NO: 103 - protein, 35 aa, Artificial Sequence
  Core polypeptide
FYDPLVFPSDEFDASISQVNEKINQSLAFIRKSDE

SEQ ID NO: 104 - protein, 35 aa, Artificial Sequence
  Core polypeptide
YDPLVFPSDEFDASISQVNEKINQSLAFIRKSDEL

SEQ ID NO: 105 - protein, 35 aa, Artificial Sequence
  Core polypeptide
DPLVFPSDEFDASISQVNEKINQSLAFIRKSDELL

SEQ ID NO: 106 - protein, 35 aa, Artificial Sequence
  Core polypeptide
PLVFPSDEFDASISQVNEKINQSLAFIRKSDELLH

SEQ ID NO: 107 - protein, 35 aa, Artificial Sequence
  Core polypeptide
LVFPSDEFDASISQVNEKINQSLAFIRKSDELLHN

SEQ ID NO: 108 - protein, 35 aa, Artificial Sequence
  Core polypeptide
VFPSDEFDASISQVNEKINQSLAFIRKSDELLHNV

SEQ ID NO: 109 - protein, 35 aa, Artificial Sequence
  Core polypeptide
FPSDEFDASISQVNEKINQSLAFIRKSDELLHNVN

SEQ ID NO: 110 - protein, 35 aa, Artificial Sequence
  Core polypeptide
PSDEFDASISQVNEKINQSLAFIRKSDELLHNVNA

SEQ ID NO: 111 - protein, 35 aa, Artificial Sequence
  Core polypeptide
SDEFDASISQVNEKINQSLAFIRKSDELLHNVNAG

SEQ ID NO: 112 - protein, 35 aa, Artificial Sequence
  Core polypeptide
DEFDASISQVNEKINQSLAFIRKSDELLHNVNAGK

SEQ ID NO: 113 - protein, 35 aa, Artificial Sequence
  Core polypeptide
EFDASISQVNEKINQSLAFIRKSDELLHNVNAGKS

SEQ ID NO: 114 - protein, 35 aa, Artificial Sequence
  Core polypeptide
FDASISQVNEKINQSLAFIRKSDELLHNVNAGKST

SEQ ID NO: 115 - protein, 35 aa, Artificial Sequence
  Core polypeptide
DASISQVNEKINQSLAFIRKSDELLHNVNAGKSTT

SEQ ID NO: 116 - protein, 35 aa, Artificial Sequence
  Core polypeptide
ASGVAVSKVLHLEGEVNKIKSALLSTNKAVVSLSN

SEQ ID NO: 117 - protein, 35 aa, Artificial Sequence; identical to SEQ ID NO: 24
  Core polypeptide

SEQ ID NO: 118 - protein, 35 aa, Artificial Sequence
  Core polypeptide
GVAVSKVLHLEGEVNKIKSALLSTNKAVVSLSNGV

SEQ ID NO: 119 - protein, 35 aa, Artificial Sequence
  Core polypeptide
VAVSKVLHLEGEVNKIKSALLSTNKAVVSLSNGVS

SEQ ID NO: 120 - protein, 35 aa, Artificial Sequence
  Core polypeptide
AVSKVLHLEGEVNKIKSALLSTNKAVVSLSNGVSV

SEQ ID NO: 121 - protein, 35 aa, Artificial Sequence
  Core polypeptide
VSKVLHLEGEVNKIKSALLSTNKAVVSLSNGVSVL

SEQ ID NO: 122 - protein, 35 aa, Artificial Sequence
  Core polypeptide
SKVLHLEGEVNKIKSALLSTNKAVVSLSNGVSVLT

SEQ ID NO: 123 - protein, 35 aa, Artificial Sequence
  Core polypeptide
KVLHLEGEVNKIKSALLSTNKAVVSLSNGVSVLTS

SEQ ID NO: 124 - protein, 35 aa, Artificial Sequence
  Core polypeptide
VLHLEGEVNKIKSALLSTNKAVVSLSNGVSVLTSK

SEQ ID NO: 125 - protein, 35 aa, Artificial Sequence
  Core polypeptide
LHLEGEVNKIKSALLSTNKAVVSLSNGVSVLTSKV

SEQ ID NO: 126 - protein, 35 aa, Artificial Sequence
  Core polypeptide
HLEGEVNKIKSALLSTNKAVVSLSNGVSVLTSKVL

SEQ ID NO: 127 - protein, 35 aa, Artificial Sequence
  Core polypeptide
LEGEVNKIKSALLSTNKAVVSLSNGVSVLTSKVLD

SEQ ID NO: 128 - protein, 35 aa, Artificial Sequence
  Core polypeptide
EGEVNKIKSALLSTNKAVVSLSNGVSVLTSKVLDL

SEQ ID NO: 129 - protein, 35 aa, Artificial Sequence
  Core polypeptide
GEVNKIKSALLSTNKAVVSLSNGVSVLTSKVLDLK

SEQ ID NO: 130 - protein, 35 aa, Artificial Sequence
  Core polypeptide
EVNKIKSALLSTNKAVVSLSNGVSVLTSKVLDLKN

SEQ ID NO: 131 - protein, 35 aa, Artificial Sequence
  Core polypeptide
VNKIKSALLSTNKAVVSLSNGVSVLTSKVLDLKNY

SEQ ID NO: 132 - protein, 35 aa, Artificial Sequence
  Core polypeptide
NKIKSALLSTNKAVVSLSNGVSVLTSKVLDLKNYI

SEQ ID NO: 133 - protein, 35 aa, Artificial Sequence
  Core polypeptide
KIKSALLSTNKAVVSLSNGVSVLTSKVLDLKNYID

SEQ ID NO: 134 - protein, 35 aa, Artificial Sequence
  Core polypeptide
IKSALLSTNKAVVSLSNGVSVLTSKVLDLKNYIDK

SEQ ID NO: 135 - protein, 35 aa, Artificial Sequence
  Core polypeptide
KSALLSTNKAVVSLSNGVSVLTSKVLDLKNYIDKQ

SEQ ID NO: 136 - protein, 35 aa, Artificial Sequence
  Core polypeptide
SALLSTNKAVVSLSNGVSVLTSKVLDLKNYIDKQL

SEQ ID NO: 137 - protein, 35 aa, Artificial Sequence
  Core polypeptide
ALLSTNKAVVSLSNGVSVLTSKVLDLKNYIDKQLL

SEQ ID NO: 138 - protein, 35 aa, Artificial Sequence
  Core polypeptide
YTSVITIELSNIKENKCNGTDAKVKLIKQELDKYK

SEQ ID NO: 139 - protein, 35 aa, Artificial Sequence
  Core polypeptide
TSVITIELSNIKENKCNGTDAKVKLIKQELDKYKN

SEQ ID NO: 140 - protein, 35 aa, Artificial Sequence
  Core polypeptide
SVITIELSNIKENKCNGTDAKVKLIKQELDKYKNA

SEQ ID NO: 141 - protein, 35 aa, Artificial Sequence
  Core polypeptide
VITIELSNIKENKCNGTDAKVKLIKQELDKYKNAV

SEQ ID NO: 142 - protein, 35 aa, Artificial Sequence
  Core polypeptide
ITIELSNIKENKCNGTDAKVKLIKQELDKYKNAVT

SEQ ID NO: 143 - protein, 35 aa, Artificial Sequence
  Core polypeptide
TIELSNIKENKCNGTDAKVKLIKQELDKYKNAVTE

SEQ ID NO: 144 - protein, 35 aa, Artificial Sequence
  Core polypeptide
IELSNIKENKCNGTDAKVKLIKQELDKYKNAVTEL

SEQ ID NO: 145 - protein, 35 aa, Artificial Sequence
  Core polypeptide
ELSNIKENKCNGTDAKVKLIKQELDKYKNAVTELQ

SEQ ID NO: 146 - protein, 35 aa, Artificial Sequence
  Core polypeptide
LSNIKENKCNGTDAKVKLIKQELDKYKNAVTELQL

SEQ ID NO: 147 - protein, 35 aa, Artificial Sequence; identical to SEQ ID NO: 22
  Core polypeptide

SEQ ID NO: 148 - protein, 35 aa, Artificial Sequence
  Core polypeptide
NIKENKCNGTDAKVKLIKQELDKYKNAVTELQLLM

SEQ ID NO: 149 - protein, 35 aa, Artificial Sequence
  Core polypeptide
IKENKCNGTDAKVKLIKQELDKYKNAVTELQLLMQ

SEQ ID NO: 150 - protein, 35 aa, Artificial Sequence
  Core polypeptide
KENKCNGTDAKVKLIKQELDKYKNAVTELQLLMQS

SEQ ID NO: 151 - protein, 35 aa, Artificial Sequence
  Core polypeptide
ENKCNGTDAKVKLIKQELDKYKNAVTELQLLMQST

SEQ ID NO: 152 - protein, 36 aa, Artificial Sequence
  Core polypeptide
LLDNFESTWEQSKELWELQEISIQNLHKSALQEYWN

SEQ ID NO: 153 - protein, 35 aa, Artificial Sequence
  Core polypeptide
ALGVATSAQITAAVALVEAKQARSDIEKLKEAIRD

SEQ ID NO: 154 - protein, 35 aa, Artificial Sequence
  Core polypeptide
LGVATSAQITAAVALVEAKQARSDIEKLKEAIRDT

SEQ ID NO: 155 - protein, 35 aa, Artificial Sequence
  Core polypeptide
GVATSAQITAAVALVEAKQARSDIEKLKEAIRDTN

SEQ ID NO: 156 - protein, 35 aa, Artificial Sequence
  Core polypeptide
VATSAQITAAVALVEAKQARSDIEKLKEAIRDTNK

SEQ ID NO: 157 - protein, 35 aa, Artificial Sequence
  Core polypeptide
ATSAQITAAVALVEAKQARSDIEKLKEAIRDTNKA

SEQ ID NO: 158 - protein, 35 aa, Artificial Sequence
  Core polypeptide
TSAQITAAVALVEAKQARSDIEKLKEAIRDTNKAV

SEQ ID NO: 159 - protein, 35 aa, Artificial Sequence
  Core polypeptide
SAQITAAVALVEAKQARSDIEKLKEAIRDTNKAVQ

SEQ ID NO: 160 - protein, 35 aa, Artificial Sequence
  Core polypeptide
AQITAAVALVEAKQARSDIEKLKEAIRDTNKAVQS

SEQ ID NO: 161 - protein, 35 aa, Artificial Sequence
  Core polypeptide
QITAAVALVEAKQARSDIEKLKEAIRDTNKAVQSV

SEQ ID NO: 162 - protein, 35 aa, Artificial Sequence
  Core polypeptide
ITAAVALVEAKQARSDIEKLKEAIRDTNKAVQSVQ

SEQ ID NO: 163 - protein, 35 aa, Artificial Sequence
  Core polypeptide
TAAVALVEAKQARSDIEKLKEAIRDTNKAVQSVQS

SEQ ID NO: 164 - protein, 35 aa, Artificial Sequence; identical to SEQ ID NO: 34
  Core polypeptide

SEQ ID NO: 165 - protein, 35 aa, Artificial Sequence
  Core polypeptide
AVALVEAKQARSDIEKLKEAIRDTNKAVQSVQSSI

SEQ ID NO: 166 - protein, 35 aa, Artificial Sequence
  Core polypeptide
VALVEAKQARSDIEKLKEAIRDTNKAVQSVQSSIG

SEQ ID NO: 167 - protein, 35 aa, Artificial Sequence
  Core polypeptide
ALVEAKQARSDIEKLKEAIRDTNKAVQSVQSSIGN

SEQ ID NO: 168 - protein, 35 aa, Artificial Sequence
  Core polypeptide
LVEAKQARSDIEKLKEAIRDTNKAVQSVQSSIGNL

SEQ ID NO: 169 - protein, 35 aa, Artificial Sequence
  Core polypeptide
VEAKQARSDIEKLKEAIRDTNKAVQSVQSSIGNLI

SEQ ID NO: 170 - protein, 35 aa, Artificial Sequence
  Core polypeptide
EAKQARSDIEKLKEAIRDTNKAVQSVQSSIGNLIV

SEQ ID NO: 171 - protein, 35 aa, Artificial Sequence
  Core polypeptide
KQARSDIEKLKEAIRDTNKAVQSVQSSIGNLIVAI

SEQ ID NO: 172 - protein, 34 aa, Artificial Sequence
  Core polypeptide
QARSDEKLKEAIRDTNKAVQSVQSSIGNLIVAIK

SEQ ID NO: 173 - protein, 35 aa, Artificial Sequence
  Core polypeptide
QARSDIEKLKEAIRDTNKAVQSVQSSIGNLIVAIK

SEQ ID NO: 174 - protein, 35 aa, Artificial Sequence
  Core polypeptide
ARSDIEKLKEAIRDTNKAVQSVQSSIGNLIVAIKS

SEQ ID NO: 175 - protein, 35 aa, Artificial Sequence
  Core polypeptide
RSDIEKLKEAIRDTNKAVQSVQSSIGNLIVAIKSV

SEQ ID NO: 176 - protein, 35 aa, Artificial Sequence
  Core polypeptide
SDIEKLKEAIRDTNKAVQSVQSSIGNLIVAIKSVQ

SEQ ID NO: 177 - protein, 35 aa, Artificial Sequence
  Core polypeptide
DIEKLKEAIRDTNKAVQSVQSSIGNLIVAIKSVQD

SEQ ID NO: 178 - protein, 35 aa, Artificial Sequence
  Core polypeptide
IEKLKEAIRDTNKAVQSVQSSIGNLIVAIKSVQDY

SEQ ID NO: 179 - protein, 35 aa, Artificial Sequence
  Core polypeptide
EKLKEAIRDTNKAVQSVQSSIGNLIVAIKSVQDYV

SEQ ID NO: 180 - protein, 35 aa, Artificial Sequence
  Core polypeptide
KLKEAIRDTNKAVQSVQSSIGNLIVAIKSVQDYVN

SEQ ID NO: 181 - protein, 35 aa, Artificial Sequence
  Core polypeptide
LKEAIRDTNKAVQSVQSSIGNLIVAIKSVQDYVNK

SEQ ID NO: 182 - protein, 35 aa, Artificial Sequence
  Core polypeptide
KEAIRDTNKAVQSVQSSIGNLIVAIKSVQDYVNKE

SEQ ID NO: 183 - protein, 35 aa, Artificial Sequence
  Core polypeptide
EAIRDTNKAVQSVQSSIGNLIVAIKSVQDYVNKEI

SEQ ID NO: 184 - protein, 35 aa, Artificial Sequence
  Core polypeptide
AIRDTNKAVQSVQSSIGNLIVAIKSVQDYVNKEIV

SEQ ID NO: 185 - protein, 34 aa, Artificial Sequence
  Core polypeptide
IRDTNKAVQSVQSSIGNLIVAIKSVQDYVNKEIV

SEQ ID NO: 186 - protein, 35 aa, Artificial Sequence
  Core polypeptide
YTPNDITLNNSVALDPIDISIELNKAKSDLEESKE

SEQ ID NO: 187 - protein, 35 aa, Artificial Sequence
  Core polypeptide
TPNDITLNNSVALDPIDISIELNKAKSDLEESKEW

SEQ ID NO: 188 - protein, 35 aa, Artificial Sequence
  Core polypeptide
PNDITLNNSVALDPIDISIELNKAKSDLEESKEWI

SEQ ID NO: 189 - protein, 35 aa, Artificial Sequence
  Core polypeptide
NDITLNNSVALDPIDISIELNKAKSDLEESKEWIR

SEQ ID NO: 190 - protein, 35 aa, Artificial Sequence
  Core polypeptide
DITLNNSVALDPIDISIELNKAKSDLEESKEWIRR

SEQ ID NO: 191 - protein, 35 aa, Artificial Sequence
  Core polypeptide
ITLNNSVALDPIDISIELNKAKSDLEESKEWIRRS

SEQ ID NO: 192 - protein, 35 aa, Artificial Sequence
  Core polypeptide
TLNNSVALDPIDISIELNKAKSDLEESKEWIRRSN

SEQ ID NO: 193 - protein, 35 aa, Artificial Sequence
  Core polypeptide
LNNSVALDPIDISIELNKAKSDLEESKEWIRRSNQ

SEQ ID NO: 194 - protein, 35 aa, Artificial Sequence
  Core polypeptide
NNSVALDPIDISIELNKAKSDLEESKEWIRRSNQK

SEQ ID NO: 195 - protein, 35 aa, Artificial Sequence
  Core polypeptide
NSVALDPIDISIELNKAKSDLEESKEWIRRSNQKL

SEQ ID NO: 196 - protein, 35 aa, Artificial Sequence
  Core polypeptide
SVALDPIDISIELNKAKSDLEESKEWIRRSNQKLD

SEQ ID NO: 197 - protein, 35 aa, Artificial Sequence
  Core polypeptide
VALDPIDISIELNKAKSDLEESKEWIRRSNQKLDS

SEQ ID NO: 198 - protein, 35 aa, Artificial Sequence
  Core polypeptide
ALDPIDISIELNKAKSDLEESKEWIRRSNQKLDSI

SEQ ID NO: 199 - protein, 35 aa, Artificial Sequence
  Core polypeptide
LDPIDISIELNKAKSDLEESKEWIRRSNQKLDSIG

SEQ ID NO: 200 - protein, 35 aa, Artificial Sequence
  Core polypeptide
DPIDISIELNKAKSDLEESKEWIRRSNQKLDSIGN

SEQ ID NO: 201 - protein, 35 aa, Artificial Sequence
  Core polypeptide
PIDISIELNKAKSDLEESKEWIRRSNQKLDSIGNW

SEQ ID NO: 202 - protein, 35 aa, Artificial Sequence
  Core polypeptide
IDISIELNKAKSDLEESKEWIRRSNQKLDSIGNWH

SEQ ID NO: 203 - protein, 35 aa, Artificial Sequence
  Core polypeptide
DISIELNKAKSDLEESKEWIRRSNQKLDSIGNWHQ

SEQ ID NO: 204 - protein, 35 aa, Artificial Sequence
  Core polypeptide
ISIELNKAKSDLEESKEWIRRSNQKLDSIGNWHQS

SEQ ID NO: 205 - protein, 35 aa, Artificial Sequence
  Core polypeptide
SIELNKAKSDLEESKEWIRRSNQKLDSIGNWHQSS

SEQ ID NO: 206 - protein, 35 aa, Artificial Sequence
  Core polypeptide
IELNKAKSDLEESKEWIRRSNQKLDSIGNWHQSST

SEQ ID NO: 207 - protein, 35 aa, Artificial Sequence
  Core polypeptide
ELNKAKSDLEESKEWIRRSNQKLDSIGNWHQSSTT

SEQ ID NO: 208 - protein, 36 aa, Artificial Sequence
  Core polypeptide
ELRALRGELRALRGELRALRGELRALRGELRALRGK

SEQ ID NO: 209 - protein, 36 aa, Artificial Sequence
  Core polypeptide
YTSLIHSLIEESQNQQQKNEQELLELDKWASLWNWF

SEQ ID NO: 210 - protein, 36 aa, Artificial Sequence
  Core polypeptide
YTSLIHSLIEESQNQQEKNEQELLELNKWASLWNWF

SEQ ID NO: 211 - protein, 36 aa, Artificial Sequence
  Core polypeptide
YTSLIHSLIEQSQNQQEKNEQELLELDKWASLWNWF

SEQ ID NO: 212 - protein, 36 aa, Artificial Sequence
  Core polypeptide
YTSLIHSLIQESQNQQEKNEQELLELDKWASLWNWF

SEQ ID NO: 213 - protein, 36 aa, Artificial Sequence
  Core polypeptide
YTSLIHSLIQQSQNQQQKNQQQLLQLNKWASLWNWF

SEQ ID NO: 214 - protein, 17 aa, Artificial Sequence
  Core polypeptide
EQELLELDKWASLWNWF

SEQ ID NO: 215 - protein, 16 aa, Artificial Sequence
  Core polypeptide
QELLELDKWASLWNWF

SEQ ID NO: 216 - protein, 15 aa, Artificial Sequence
  Core polypeptide
ELLELDKWASLWNWF

SEQ ID NO: 217 - protein, 14 aa, Artificial Sequence
  Core polypeptide
LLELDKWASLWNWF

SEQ ID NO: 218 - protein, 13 aa, Artificial Sequence
  Core polypeptide
LELDKWASLWNWF

SEQ ID NO: 219 - protein, 12 aa, Artificial Sequence
  Core polypeptide
ELDKWASLWNWF

SEQ ID NO: 220 - protein, 11 aa, Artificial Sequence
  Core polypeptide
LDKWASLWNWF

SEQ ID NO: 221 - protein, 10 aa, Artificial Sequence
  Core polypeptide
DKWASLWNWF

SEQ ID NO: 222 - protein, 9 aa, Artificial Sequence
  Core polypeptide
KWASLWNWF

SEQ ID NO: 223 - protein, 8 aa, Artificial Sequence
  Core polypeptide
WASLWNWF

SEQ ID NO: 224 - protein, 7 aa, Artificial Sequence
  Core polypeptide
ASLWNWF

SEQ ID NO: 225 - protein, 18 aa, Artificial Sequence
  Core polypeptide
YTSLIHSLIEESQNQQEK

SEQ ID NO: 226 - protein, 36 aa, Artificial Sequence
  Core polypeptide
YTSLIHSLIEESQNQQEKNEQELLELDKWASLANAA

SEQ ID NO: 227 - protein, 36 aa, Artificial Sequence
  Core polypeptide
YTSLIHSLIEESQNQQEKNEQQLLELDKWASLWNWF

SEQ ID NO: 228 - protein, 36 aa, Artificial Sequence
  Core polypeptide
YTSLIQSLIEESQNQQEKNQQELLELDKWASLWNWF

SEQ ID NO: 229 - protein, 14 aa, Artificial Sequence
  Core polypeptide
CLELDKWASLWNWF

SEQ ID NO: 230 - protein, 13 aa, Artificial Sequence
  Core polypeptide
LELDKFASLFNFF

SEQ ID NO: 231 - protein, 28 aa, Artificial Sequence
  Core polypeptide
EAAAREAAAREAAARLELDKWASLWNWF

SEQ ID NO: 232 - protein, 28 aa, Artificial Sequence
  Core polypeptide
RMKQLEDKVEELLSKLELDKWASLWNWF

SEQ ID NO: 233 - protein, 35 aa, Artificial Sequence
  Core polypeptide
PSLRDPISAEISIQALSYALGGDINKVLEKLGYSG

SEQ ID NO: 234 - protein, 35 aa, Artificial Sequence
  Core polypeptide
SLRDPISAEISIQALSYALGGDINKVLEKLGYSGG

SEQ ID NO: 235 - protein, 35 aa, Artificial Sequence
  Core polypeptide
LRDPISAEISIQALSYALGGDINKVLEKLGYSGGD

SEQ ID NO: 236 - protein, 35 aa, Artificial Sequence
  Core polypeptide
RDPISAEISIQALSYALGGDINKVLEKLGYSGGDL

SEQ ID NO: 237 - protein, 35 aa, Artificial Sequence
  Core polypeptide
DPISAEISIQALSYALGGDINKVLEKLGYSGGDLL

SEQ ID NO: 238 - protein, 35 aa, Artificial Sequence
  Core polypeptide
PISAEISIQALSYALGGDINKVLEKLGYSGGDLLG

SEQ ID NO: 239 - protein, 35 aa, Artificial Sequence
  Core polypeptide
ISAEISIQALSYALGGDINKVLEKLGYSGGDLLGI

SEQ ID NO: 240 - protein, 35 aa, Artificial Sequence
  Core polypeptide
SAEISIQALSYALGGDINKVLEKLGYSGGDLLGIL

SEQ ID NO: 241 - protein, 35 aa, Artificial Sequence
  Core polypeptide
AEISIQALSYALGGDINKVLEKLGYSGGDLLGILE

SEQ ID NO: 242 - protein, 35 aa, Artificial Sequence
  Core polypeptide
EISIQALSYALGGDINKVLEKLGYSGGDLLGILES

SEQ ID NO: 243 - protein, 35 aa, Artificial Sequence
  Core polypeptide
ISIQALSYALGGDINKVLEKLGYSGGDLLGILESR

SEQ ID NO: 244 - protein, 35 aa, Artificial Sequence
  Core polypeptide
SIQALSYALGGDINKVLEKLGYSGGDLLGILESRG

SEQ ID NO: 245 - protein, 35 aa, Artificial Sequence
  Core polypeptide
IQALSYALGGDINKVLEKLGYSGGDLLGILESRGI

SEQ ID NO: 246 - protein, 35 aa, Artificial Sequence
  Core polypeptide
QALSYALGGDINKVLEKLGYSGGDLLGILESRGIK

SEQ ID NO: 247 - protein, 35 aa, Artificial Sequence
  Core polypeptide
ALSYALGGDINKVLEKLGYSGGDLLGILESRGIKA

SEQ ID NO: 248 - protein, 35 aa, Artificial Sequence
  Core polypeptide
LSYALGGDINKVLEKLGYSGGDLLGILESRGIKAR

SEQ ID NO: 249 - protein, 35 aa, Artificial Sequence
  Core polypeptide
PDAVYLHRIDLGPPISLERLDVGTNLGNAIAKLED

SEQ ID NO: 250 - protein, 35 aa, Artificial Sequence
  Core polypeptide
DAVYLHRIDLGPPISLERLDVGTNLGNAIAKLEDA

SEQ ID NO: 251 - protein, 35 aa, Artificial Sequence
  Core polypeptide
AVYLHRIDLGPPISLERLDVGTNLGNAIAKLEDAK

SEQ ID NO: 252 - protein, 35 aa, Artificial Sequence
  Core polypeptide
VYLHRIDLGPPISLERLDVGTNLGNAIAKLEDAKE

SEQ ID NO: 253 - protein, 35 aa, Artificial Sequence
  Core polypeptide
YLHRIDLGPPISLERLDVGTNLGNAIAKLEDAKEL

SEQ ID NO: 254 - protein, 35 aa, Artificial Sequence
  Core polypeptide
LHRIDLGPPISLERLDVGTNLGNAIAKLEDAKELL

SEQ ID NO: 255 - protein, 35 aa, Artificial Sequence
  Core polypeptide
HRIDLGPPISLERLDVGTNLGNAIAKLEDAKELLE

SEQ ID NO: 256 - protein, 35 aa, Artificial Sequence
  Core polypeptide
RIDLGPPISLERLDVGTNLGNAIAKLEDAKELLES

SEQ ID NO: 257 - protein, 35 aa, Artificial Sequence
  Core polypeptide
IDLGPPISLERLDVGTNLGNAIAKLEDAKELLESS

SEQ ID NO: 258 - protein, 35 aa, Artificial Sequence
  Core polypeptide
DLGPPISLERLDVGTNLGNAIAKLEDAKELLESSD

SEQ ID NO: 259 - protein, 35 aa, Artificial Sequence
  Core polypeptide
LGPPISLERLDVGTNLGNAIAKLEDAKELLESSDQ

SEQ ID NO: 260 - protein, 35 aa, Artificial Sequence
  Core polypeptide
GPPISLERLDVGTNLGNAIAKLEDAKELLESSDQI

SEQ ID NO: 261 - protein, 35 aa, Artificial Sequence
  Core polypeptide
PPISLERLDVGTNLGNAIAKLEDAKELLESSDQIL

SEQ ID NO: 262 - protein, 35 aa, Artificial Sequence
  Core polypeptide
PISLERLDVGTNLGNAIAKLEDAKELLESSDQILR

SEQ ID NO: 263 - protein, 34 aa, Artificial Sequence
  Core polypeptide
ISLERLDVGTNLGNAIAKLEDAKELLESSDQIRS

SEQ ID NO: 264 - protein, 35 aa, Artificial Sequence
  Core polypeptide
SLERLDVGTNLGNAIAKLEDAKELLESSDQILRSM

SEQ ID NO: 265 - protein, 35 aa, Artificial Sequence
  Core polypeptide
LERLDVGTNLGNAIAKLEDAKELLESSDQILRSMK

SEQ ID NO: 266 - protein, 13 aa, Artificial Sequence
  Core polypeptide
EWIRRSNQKLDSI

SEQ ID NO: 267 - protein, 13 aa, Artificial Sequence
  Core polypeptide
LELDKWASLANAF

SEQ ID NO: 268 - protein, 13 aa, Artificial Sequence
  Core polypeptide
LELDKWASLFNFF

SEQ ID NO: 269 - protein, 13 aa, Artificial Sequence
  Core polypeptide
LELDKWASLANWF

SEQ ID NO: 270 - protein, 13 aa, Artificial Sequence
  Core polypeptide
LELDKWASLWNAF

SEQ ID NO: 271 - protein, 35 aa, Artificial Sequence
  Core polypeptide
ELGNVNNSISNALDKLEESNSKLDKVNVKLTSTSA

SEQ ID NO: 272 - protein, 35 aa, Artificial Sequence
  Core polypeptide
TELGNVNNSISNALDKLEESNSKLDKVNVKLTSTS

SEQ ID NO: 273 - protein, 35 aa, Artificial Sequence
  Core polypeptide
STELGNVNNSISNALDKLEESNSKLDKVNVKLTST

SEQ ID NO: 274 - protein, 35 aa, Artificial Sequence
  Core polypeptide
ISTELGNVNNSISNALDKLEESNSKLDKVNVKLTS

SEQ ID NO: 275 - protein, 35 aa, Artificial Sequence
  Core polypeptide
DISTELGNVNNSISNALDKLEESNSKLDKVNVKLT

SEQ ID NO: 276 - protein, 35 aa, Artificial Sequence
  Core polypeptide
LDISTELGNVNNSISNALDKLEESNSKLDKVNVKL

SEQ ID NO: 277 - protein, 35 aa, Artificial Sequence
  Core polypeptide
NLDISTELGNVNNSISNALDKLEESNSKLDKVNVK

SEQ ID NO: 278 - protein, 35 aa, Artificial Sequence
  Core polypeptide
GNLDISTELGNVNNSISNALDKLEESNSKLDKVNV

SEQ ID NO: 279 - protein, 35 aa, Artificial Sequence
  Core polypeptide
TGNLDISTELGNVNNSISNALDKLEESNSKLDKVN

SEQ ID NO: 280 - protein, 35 aa, Artificial Sequence
  Core polypeptide
VTGNLDISTELGNVNNSISNALDKLEESNSKLDKV

SEQ ID NO: 281 - protein, 35 aa, Artificial Sequence
  Core polypeptide
IVTGNLDISTELGNVNNSISNALDKLEESNSKLDK

SEQ ID NO: 282 - protein, 35 aa, Artificial Sequence
  Core polypeptide
VIVTGNLDISTELGNVNNSISNALDKLEESNSKLD

SEQ ID NO: 283 - protein, 35 aa, Artificial Sequence
  Core polypeptide
QVIVTGNLDISTELGNVNNSISNALDKLEESNSKL

SEQ ID NO: 284 - protein, 35 aa, Artificial Sequence
  Core polypeptide
SQVIVTGNLDISTELGNVNNSISNALDKLEESNSK

SEQ ID NO: 285 - protein, 35 aa, Artificial Sequence
  Core polypeptide
DSQVIVTGNLDISTELGNVNNSISNALDKLEESNS

SEQ ID NO: 286 - protein, 35 aa, Artificial Sequence
  Core polypeptide
LDSQVIVTGNLDISTELGNVNNSISNALDKLEESN

SEQ ID NO: 287 - protein, 35 aa, Artificial Sequence
  Core polypeptide
ILDSQVIVTGNLDISTELGNVNNSISNALDKLEES

SEQ ID NO: 288 - protein, 35 aa, Artificial Sequence
  Core polypeptide
SILDSQVIVTGNLDISTELGNVNNSISNALDKLEE

SEQ ID NO: 289 - protein, 35 aa, Artificial Sequence
  Core polypeptide
ISILDSQVIVTGNLDISTELGNVNNSISNALDKLE

SEQ ID NO: 290 - protein, 35 aa, Artificial Sequence
  Core polypeptide
NISILDSQVIVTGNLDISTELGNVNNSISNALDKL

SEQ ID NO: 291 - protein, 35 aa, Artificial Sequence
  Core polypeptide
KNISILDSQVIVTGNLDISTELGNVNNSISNALDK

SEQ ID NO: 292 - protein, 35 aa, Artificial Sequence
  Core polypeptide
QKNISILDSQVIVTGNLDISTELGNVNNSISNALD

SEQ ID NO: 293 - protein, 35 aa, Artificial Sequence
  Core polypeptide
YQKNISILDSQVIVTGNLDISTELGNVNNSISNAL

SEQ ID NO: 294 - protein, 35 aa, Artificial Sequence
  Core polypeptide
TYQKNISILDSQVIVTGNLDISTELGNVNNSISNA

SEQ ID NO: 295 - protein, 35 aa, Artificial Sequence
  Core polypeptide
ATYQKNISILDSQVIVTGNLDISTELGNVNNSISN

SEQ ID NO: 296 - protein, 35 aa, Artificial Sequence
  Core polypeptide
DATYQKNISILDSQVIVTGNLDISTELGNVNNSIS

SEQ ID NO: 297 - protein, 35 aa, Artificial Sequence
  Core polypeptide
FDATYQKNISILDSQVIVTGNLDISTELGNVNNSI

SEQ ID NO: 298 - protein, 35 aa, Artificial Sequence
  Core polypeptide
EFDATYQKNISILDSQVIVTGNLDISTELGNVNNS

SEQ ID NO: 299 - protein, 35 aa, Artificial Sequence
  Core polypeptide
GEFDATYQKNISILDSQVIVTGNLDISTELGNVNN

SEQ ID NO: 300 - protein, 35 aa, Artificial Sequence
  Core polypeptide
SGEFDATYQKNISILDSQVIVTGNLDISTELGNVN

SEQ ID NO: 301 - protein, 35 aa, Artificial Sequence
  Core polypeptide
LSGEFDATYQKNISILDSQVIVTGNLDISTELGNV

SEQ ID NO: 302 - protein, 35 aa, Artificial Sequence
  Core polypeptide
RLSGEFDATYQKNISILDSQVIVTGNLDISTELGN

SEQ ID NO: 303 - protein, 35 aa, Artificial Sequence
  Core polypeptide
LRLSGEFDATYQKNISILDSQVIVTGNLDISTELG

SEQ ID NO: 304 - protein, 35 aa, Artificial Sequence
  Core polypeptide
TLRLSGEFDATYQKNISILDSQVIVTGNLDISTEL

SEQ ID NO: 305 - protein, 35 aa, Artificial Sequence
  Core polypeptide
ITLRLSGEFDATYQKNISILDSQVIVTGNLDISTE

SEQ ID NO: 306 - protein, 35 aa, Artificial Sequence
  Core polypeptide
GITLRLSGEFDATYQKNISILDSQVIVTGNLDIST

SEQ ID NO: 307 - protein, 35 aa, Artificial Sequence
  Core polypeptide
TATIEAVHEVTDGLSQLAVAVGKMQQFVNDQFNNT

SEQ ID NO: 308 - protein, 35 aa, Artificial Sequence
  Core polypeptide
ITATIEAVHEVTDGLSQLAVAVGKMQQFVNDQFNN

SEQ ID NO: 309 - protein, 35 aa, Artificial Sequence
  Core polypeptide
SITATIEAVHEVTDGLSQLAVAVGKMQQFVNDQFN

SEQ ID NO: 310 - protein, 35 aa, Artificial Sequence
  Core polypeptide
KESITATIEAVHEVTDGLSQLAVAVGKMQQFVNDQ

SEQ ID NO: 311 - protein, 35 aa, Artificial Sequence
  Core polypeptide
LKESITATIEAVHEVTDGLSQLAVAVGKMQQFVND

SEQ ID NO: 312 - protein, 35 aa, Artificial Sequence
  Core polypeptide
RLKESITATIEAVHEVTDGLSQLAVAVGKMQQFVN

SEQ ID NO: 313 - protein, 35 aa, Artificial Sequence
  Core polypeptide
LRLKESITATIEAVHEVTDGLSQLAVAVGKMQQFV

SEQ ID NO: 314 - protein, 35 aa, Artificial Sequence
  Core polypeptide
ILRLKESITATIEAVHEVTDGLSQLAVAVGKMQQF

SEQ ID NO: 315 - protein, 35 aa, Artificial Sequence
  Core polypeptide
NILRLKESITATIEAVHEVTDGLSQLAVAVGKMQQ

SEQ ID NO: 316 - protein, 35 aa, Artificial Sequence
  Core polypeptide
ANILRLKESITATIEAVHEVTDGLSQLAVAVGKMQ

SEQ ID NO: 317 - protein, 35 aa, Artificial Sequence
  Core polypeptide
AANILRLKESITATIEAVHEVTDGLSQLAVAVGKM

SEQ ID NO: 318 - protein, 35 aa, Artificial Sequence
  Core polypeptide
HKCDDECMNSVKNGTYDYPKYEEESKLNRNEIKGV

SEQ ID NO: 319 - protein, 35 aa, Artificial Sequence
  Core polypeptide
KCDDECMNSVKNGTYDYPKYEEESKLNRNEIKGVK

SEQ ID NO: 320 - protein, 35 aa, Artificial Sequence
  Core polypeptide
CDDECMNSVKNGTYDYPKYEEESKLNRNEIKGVKL

SEQ ID NO: 321 - protein, 35 aa, Artificial Sequence
  Core polypeptide
DDECMNSVKNGTYDYPKYEEESKLNRNEIKGVKLS

SEQ ID NO: 322 - protein, 35 aa, Artificial Sequence
  Core polypeptide
DECMNSVKNGTYDYPKYEEESKLNRNEIKGVKLSS

SEQ ID NO: 323 - protein, 35 aa, Artificial Sequence
  Core polypeptide
ECMNSVKNGTYDYPKYEEESKLNRNEIKGVKLSSM

SEQ ID NO: 324 - protein, 35 aa, Artificial Sequence
  Core polypeptide
CMNSVKNGTYDYPKYEEESKLNRNEIKGVKLSSMG

SEQ ID NO: 325 - protein, 35 aa, Artificial Sequence
  Core polypeptide
MNSVKNGTYDYPKYEEESKLNRNEIKGVKLSSMGV

SEQ ID NO: 326 - protein, 35 aa, Artificial Sequence
  Core polypeptide
NSVKNGTYDYPKYEEESKLNRNEIKGVKLSSMGVY

SEQ ID NO: 327 - protein, 35 aa, Artificial Sequence
  Core polypeptide
SVKNGTYDYPKYEEESKLNRNEIKGVKLSSMGVYQ

SEQ ID NO: 328 - protein, 35 aa, Artificial Sequence
  Core polypeptide
VKNGTYDYPKYEEESKLNRNEIKGVKLSSMGVYQI

SEQ ID NO: 329 - protein, 35 aa, Artificial Sequence
  Core polypeptide
KNGTYDYPKYEEESKLNRNEIKGVKLSSMGVYQIL

SEQ ID NO: 330 - protein, 13 aa, Artificial Sequence
  Core polypeptide
AFIRKSDELLHNV

SEQ ID NO: 331 - protein, 35 aa, Artificial Sequence
  Core polypeptide
VVLAGAALGVATAAQITAGIALHQSMLNSQAIDNL

SEQ ID NO: 332 - protein, 35 aa, Artificial Sequence
  Core polypeptide
VLAGAALGVATAAQITAGIALHQSMLNSQAIDNLR

SEQ ID NO: 333 - protein, 35 aa, Artificial Sequence
  Core polypeptide
LAGAALGVATAAQITAGIALHQSMLNSQAIDNLRA

SEQ ID NO: 334 - protein, 35 aa, Artificial Sequence
  Core polypeptide
AGAALGVATAAQITAGIALHQSMLNSQAIDNLRAS

SEQ ID NO: 335 - protein, 35 aa, Artificial Sequence
  Core polypeptide
GAALGVATAAQITAGIALHQSMLNSQAIDNLRASL

SEQ ID NO: 336 - protein, 35 aa, Artificial Sequence
  Core polypeptide
AALGVATAAQITAGIALHQSMLNSQAIDNLRASLE

SEQ ID NO: 337 - protein, 35 aa, Artificial Sequence
  Core polypeptide
ALGVATAAQITAGIALHQSMLNSQAIDNLRASLET

SEQ ID NO: 338 - protein, 35 aa, Artificial Sequence
  Core polypeptide
LGVATAAQITAGIALHQSMLNSQAIDNLRASLETT

SEQ ID NO: 339 - protein, 35 aa, Artificial Sequence
  Core polypeptide
GVATAAQITAGIALHQSMLNSQAIDNLRASLETTN

SEQ ID NO: 340 - protein, 35 aa, Artificial Sequence
  Core polypeptide
VATAAQITAGIALHQSMLNSQAIDNLRASLETTNQ

SEQ ID NO: 341 - protein, 35 aa, Artificial Sequence
  Core polypeptide
ATAAQITAGIALHQSMLNSQAIDNLRASLETTNQA

SEQ ID NO: 342 - protein, 35 aa, Artificial Sequence
  Core polypeptide
TAAQITAGIALHQSMLNSQAIDNLRASLETTNQAI

SEQ ID NO: 343 - protein, 35 aa, Artificial Sequence
  Core polypeptide
AAQITAGIALHQSMLNSQAIDNLRASLETTNQAIE

SEQ ID NO: 344 - protein, 35 aa, Artificial Sequence
  Core polypeptide
AQITAGIALHQSMLNSQAIDNLRASLETTNQAIEA

SEQ ID NO: 345 - protein, 35 aa, Artificial Sequence
  Core polypeptide
QITAGIALHQSMLNSQAIDNLRASLETTNQAIEAI

SEQ ID NO: 346 - protein, 35 aa, Artificial Sequence
  Core polypeptide
ITAGIALHQSMLNSQAIDNLRASLETTNQAIEAIR

SEQ ID NO: 347 - protein, 35 aa, Artificial Sequence
  Core polypeptide
TAGIALHQSMLNSQAIDNLRASLETTNQAIEAIRQ

SEQ ID NO: 348 - protein, 35 aa, Artificial Sequence
  Core polypeptide
AGIALHQSMLNSQAIDNLRASLETTNQAIEAIRQA

SEQ ID NO: 349 - protein, 35 aa, Artificial Sequence
  Core polypeptide
GIALHQSMLNSQAIDNLRASLETTNQAIEAIRQAG

SEQ ID NO: 350 - protein, 35 aa, Artificial Sequence
  Core polypeptide
IALHQSMLNSQAIDNLRASLETTNQAIEAIRQAGQ

SEQ ID NO: 351 - protein, 35 aa, Artificial Sequence
  Core polypeptide
ALHQSMLNSQAIDNLRASLETTNQAIEAIRQAGQE

SEQ ID NO: 352 - protein, 35 aa, Artificial Sequence
  Core polypeptide
LHQSMLNSQAIDNLRASLETTNQAIEAIRQAGQEM

SEQ ID NO: 353 - protein, 35 aa, Artificial Sequence
  Core polypeptide
HQSMLNSQAIDNLRASLETTNQAIEAIRQAGQEMI

SEQ ID NO: 354 - protein, 35 aa, Artificial Sequence
  Core polypeptide
QSMLNSQAIDNLRASLETTNQAIEAIRQAGQEMIL

SEQ ID NO: 355 - protein, 35 aa, Artificial Sequence
  Core polypeptide
SMLNSQAIDNLRASLETTNQAIEAIRQAGQEMILA

SEQ ID NO: 356 - protein, 35 aa, Artificial Sequence
  Core polypeptide
MLNSQAIDNLRASLETTNQAIEAIRQAGQEMILAV

SEQ ID NO: 357 - protein, 35 aa, Artificial Sequence
  Core polypeptide
LNSQAIDNLRASLETTNQAIEAIRQAGQEMILAVQ

SEQ ID NO: 358 - protein, 35 aa, Artificial Sequence
  Core polypeptide
NSQAIDNLRASLETTNQAIEAIRQAGQEMILAVQG

SEQ ID NO: 359 - protein, 35 aa, Artificial Sequence
  Core polypeptide
SQAIDNLRASLETTNQAIEAIRQAGQEMILAVQGV

SEQ ID NO: 360 - protein, 35 aa, Artificial Sequence
  Core polypeptide
QAIDNLRASLETTNQAIEAIRQAGQEMILAVQGVQ

SEQ ID NO: 361 - protein, 35 aa, Artificial Sequence
  Core polypeptide
AIDNLRASLETTNQAIEAIRQAGQEMILAVQGVQD

SEQ ID NO: 362 - protein, 35 aa, Artificial Sequence
  Core polypeptide
IDNLRASLETTNQAIEAIRQAGQEMILAVQGVQDY

SEQ ID NO: 363 - protein, 35 aa, Artificial Sequence
  Core polypeptide
DNLRASLETTNQAIEAIRQAGQEMILAVQGVQDYI

SEQ ID NO: 364 - protein, 35 aa, Artificial Sequence
  Core polypeptide
NLRASLETTNQAIEAIRQAGQEMILAVQGVQDYIN

SEQ ID NO: 365 - protein, 35 aa, Artificial Sequence
  Core polypeptide
LRASLETTNQAIEAIRQAGQEMILAVQGVQDYINN

SEQ ID NO: 366 - protein, 35 aa, Artificial Sequence
  Core polypeptide
RASLETTNQAIEAIRQAGQEMILAVQGVQDYINNE

SEQ ID NO: 367 - protein, 33 aa, Artificial Sequence
  Core polypeptide
YTSVITIELSNIKENKNGTDAVKLIKQELDKYK

SEQ ID NO: 368 - protein, 33 aa, Artificial Sequence
  Core polypeptide
TSVITIELSNIKENKNGTDAVKLIKQELDKYKN

SEQ ID NO: 369 - protein, 33 aa, Artificial Sequence
  Core polypeptide
SVITIELSNIKENKNGTDAVKLIKQELDKYKNA

SEQ ID NO: 370 - protein, 34 aa, Artificial Sequence
  Core polypeptide
SNIKENKNGTDAKVKLIKQELDKYKNAVTELQLL

SEQ ID NO: 371 - protein, 34 aa, Artificial Sequence
  Core polypeptide
KENKNGTDAKVKLIKQELDKYKNAVTELQLLMQS

SEQ ID NO: 372 - protein, 15 aa, Artificial Sequence
  Core polypeptide
CLELDKWASLWNWFC

SEQ ID NO: 373 - protein, 15 aa, Artificial Sequence
  Core polypeptide
CLELDKWASLANWFC

SEQ ID NO: 374 - protein, 15 aa, Artificial Sequence
  Core polypeptide
CLELDKWASLFNFFC

SEQ ID NO: 375 - protein, 36 aa, Artificial Sequence
  Core polypeptide
YTSLIHSLIEESQNQQEKNEQELLELDKWASLFNFF

SEQ ID NO: 376 - protein, 35 aa, Artificial Sequence
  Core polypeptide
RMKQLEDKVEELLSKNYHLENELELDKWASLWNWF

SEQ ID NO: 377 - protein, 28 aa, Artificial Sequence
  Core polypeptide
KVEELLSKNYHLENELELDKWASLWNWF

SEQ ID NO: 378 - protein, 29 aa, Artificial Sequence
  Core polypeptide
RMKQLEDKVEELLSKLEWIRRSNQKLDSI

SEQ ID NO: 379 - protein, 29 aa, Artificial Sequence
  Core polypeptide
RMKQLEDKVEELLSKLAFIRKSDELLHNV

SEQ ID NO: 380 - protein, 28 aa, Artificial Sequence
  Core polypeptide
ELEALRGELRALRGELELDKWASLWNWF

SEQ ID NO: 381 - protein, 34 aa, Artificial Sequence
  Core polypeptide
LDPIDISIELNKAKSDLEESKEWIRRSNQKLDSI

SEQ ID NO: 382 - protein, 16 aa, Artificial Sequence
  Core polypeptide
CNEQLSDSFPVEFFQV

SEQ ID NO: 383 - protein, 21 aa, Artificial Sequence
  Core polypeptide
MAEDDPYLGRPEQMFHLDPSL

SEQ ID NO: 384 - protein, 20 aa, Artificial Sequence
  Core polypeptide
EDFSSIADMDFSALLSQISS

SEQ ID NO: 385 - protein, 35 aa, Artificial Sequence
  Core polypeptide
TWQEWERKVDFLEENITALLEEAQIQQEKNMYELQ

SEQ ID NO: 386 - protein, 35 aa, Artificial Sequence
  Core polypeptide
WQEWERKVDFLEENITALLEEAQIQQEKNMYELQK

SEQ ID NO: 387 - protein, 35 aa, Artificial Sequence
  Core polypeptide
QEWERKVDFLEENITALLEEAQIQQEKNMYELQKL

SEQ ID NO: 388 - protein, 35 aa, Artificial Sequence
  Core polypeptide
EWERKVDFLEENITALLEEAQIQQEKNMYELQKLN

SEQ ID NO: 389 - protein, 35 aa, Artificial Sequence
  Core polypeptide
WERKVDFLEENITALLEEAQIQQEKNMYELQKLNS

SEQ ID NO: 390 - protein, 35 aa, Artificial Sequence
  Core polypeptide
ERKVDFLEENITALLEEAQIQQEKNMYELQKLNSW

SEQ ID NO: 391 - protein, 35 aa, Artificial Sequence
  Core polypeptide
RKVDFLEENITALLEEAQIQQEKNMYELQKLNSWD

SEQ ID NO: 392 - protein, 35 aa, Artificial Sequence
  Core polypeptide
KVDFLEENITALLEEAQIQQEKNMYELQKLNSWDV

SEQ ID NO: 393 - protein, 35 aa, Artificial Sequence
  Core polypeptide
VDFLEENITALLEEAQIQQEKNMYELQKLNSWDVF

SEQ ID NO: 394 - protein, 35 aa, Artificial Sequence
  Core polypeptide
DFLEENITALLEEAQIQQEKNMYELQKLNSWDVFG

SEQ ID NO: 395 - protein, 35 aa, Artificial Sequence
  Core polypeptide
FLEENITALLEEAQIQQEKNMYELQKLNSWDVFGN

SEQ ID NO: 396 - protein, 35 aa, Artificial Sequence
  Core polypeptide
LEENITALLEEAQIQQEKNMYELQKLNSWDVFGNW

SEQ ID NO: 397 - protein, 36 aa, Artificial Sequence
  Core polypeptide
LEENITALLEEAQIQQEKNMYELQKLNSWDVFGNWF

SEQ ID NO: 398 - protein, 36 aa, Artificial Sequence
  Core polypeptide
NEQSEEKENELYWAKEQLLDLLFNIFNQTVGAWIMQ

SEQ ID NO: 399 - protein, 33 aa, Artificial Sequence
  Core polypeptide
EWERKVDFLEENITALLEEAQIQQEKNMYEGGC

SEQ ID NO: 400 - protein, 38 aa, Artificial Sequence
  Core polypeptide
QQQLLDVVKRQQELLRLTVWGTKNLQTRVTAIEKYLKD

SEQ ID NO: 401 - protein, 38 aa, Artificial Sequence
  Core polypeptide
QQLLDVVKRQQELLRLTVWGTKNLQTRVTAIEKYLKDQ

SEQ ID NO: 402 - protein, 38 aa, Artificial Sequence
  Core polypeptide
QQLLDVVKRQQELLRLTVWGPKNLQTRVTAIEKYLKDQ

SEQ ID NO: 403 - protein, 38 aa, Artificial Sequence
  Core polypeptide
DERKQDKVLVVQQTGTLQLTLIQLEKTAKLQWVRLNRY

SEQ ID NO: 404 - protein, 35 aa, Artificial Sequence
  Core polypeptide
QQQLLDVVKRQQELLRLTVWGTKNLQTRVTAIEKY

SEQ ID NO: 405 - protein, 35 aa, Artificial Sequence
  Core polypeptide
QQLLDVVKRQQELLRLTVWGTKNLQTRVTAIEKYL

SEQ ID NO: 406 - protein, 35 aa, Artificial Sequence
  Core polypeptide
QLLDVVKRQQELLRLTVWGTKNLQTRVTAIEKYLK

SEQ ID NO: 407 - protein, 35 aa, Artificial Sequence
  Core polypeptide
LLDVVKRQQELLRLTVWGTKNLQTRVTAIEKYLKD

SEQ ID NO: 408 - protein, 35 aa, Artificial Sequence
  Core polypeptide
LDVVKRQQELLRLTVWGTKNLQTRVTAIEKYLKDQ

SEQ ID NO: 409 - protein, 35 aa, Artificial Sequence
  Core polypeptide
DVVKRQQELLRLTVWGTKNLQTRVTAIEKYLKDQA

SEQ ID NO: 410 - protein, 35 aa, Artificial Sequence
  Core polypeptide
VVKRQQELLRLTVWGTKNLQTRVTAIEKYLKDQAQ

SEQ ID NO: 411 - protein, 35 aa, Artificial Sequence
  Core polypeptide
VKRQQELLRLTVWGTKNLQTRVTAIEKYLKDQAQL

SEQ ID NO: 412 - protein, 35 aa, Artificial Sequence
  Core polypeptide
KRQQELLRLTVWGTKNLQTRVTAIEKYLKDQAQLN

SEQ ID NO: 413 - protein, 35 aa, Artificial Sequence
  Core polypeptide
RQQELLRLTVWGTKNLQTRVTAIEKYLKDQAQLNA

SEQ ID NO: 414 - protein, 35 aa, Artificial Sequence
  Core polypeptide
QQELLRLTVWGTKNLQTRVTAIEKYLKDQAQLNAW

SEQ ID NO: 415 - protein, 35 aa, Artificial Sequence
  Core polypeptide
QELLRLTVWGTKNLQTRVTAIEKYLKDQAQLNAWG

SEQ ID NO: 416 - protein, 35 aa, Artificial Sequence
  Core polypeptide
ELLRLTVWGTKNLQTRVTAIEKYLKDQAQLNAWGC

SEQ ID NO: 417 - protein, 38 aa, Artificial Sequence
  Core polypeptide
NNLLRAIEAQQHLLQLTVWGPKQLQARILAVERYLKDQ

SEQ ID NO: 418 - protein, 35 aa, Artificial Sequence
  Core polypeptide
SELEIKRYKNRVASRKCRAKFKQLLQHYREVAAAK

SEQ ID NO: 419 - protein, 35 aa, Artificial Sequence
  Core polypeptide
ELEIKRYKNRVASRKCRAKFKQLLQHYREVAAAKS

SEQ ID NO: 420 - protein, 35 aa, Artificial Sequence
  Core polypeptide
LEIKRYKNRVASRKCRAKFKQLLQHYREVAAAKSS

SEQ ID NO: 421 - protein, 35 aa, Artificial Sequence
  Core polypeptide
EIKRYKNRVASRKCRAKFKQLLQHYREVAAAKSSE

SEQ ID NO: 422 - protein, 35 aa, Artificial Sequence
  Core polypeptide
IKRYKNRVASRKCRAKFKQLLQHYREVAAAKSSEN

SEQ ID NO: 423 - protein, 35 aa, Artificial Sequence
  Core polypeptide
KRYKNRVASRKCRAKFKQLLQHYREVAAAKSSEND

SEQ ID NO: 424 - protein, 35 aa, Artificial Sequence
  Core polypeptide
RYKNRVASRKCRAKFKQLLQHYREVAAAKSSENDR

SEQ ID NO: 425 - protein, 35 aa, Artificial Sequence
  Core polypeptide
YKNRVASRKCRAKFKQLLQHYREVAAAKSSENDRL

SEQ ID NO: 426 - protein, 35 aa, Artificial Sequence
  Core polypeptide
KNRVASRKCRAKFKQLLQHYREVAAAKSSENDRLR

SEQ ID NO: 427 - protein, 35 aa, Artificial Sequence
  Core polypeptide
NRVASRKCRAKFKQLLQHYREVAAAKSSENDRLRL

SEQ ID NO: 428 - protein, 35 aa, Artificial Sequence
  Core polypeptide
RVASRKCRAKFKQLLQHYREVAAAKSSENDRLRLL

SEQ ID NO: 429 - protein, 35 aa, Artificial Sequence
  Core polypeptide
VASRKCRAKFKQLLQHYREVAAAKSSENDRLRLLL

SEQ ID NO: 430 - protein, 35 aa, Artificial Sequence
  Core polypeptide
ASRKCRAKFKQLLQHYREVAAAKSSENDRLRLLLK

SEQ ID NO: 431 - protein, 35 aa, Artificial Sequence
  Core polypeptide
SRKCRAKFKQLLQHYREVAAAKSSENDRLRLLLKQ

SEQ ID NO: 432 - protein, 35 aa, Artificial Sequence
  Core polypeptide
RKCRAKFKQLLQHYREVAAAKSSENDRLRLLLKQM

SEQ ID NO: 433 - protein, 35 aa, Artificial Sequence
  Core polypeptide
KCRAKFKQLLQHYREVAAAKSSENDRLRLLLKQMC

SEQ ID NO: 434 - protein, 35 aa, Artificial Sequence
  Core polypeptide
CRAKFKQLLQHYREVAAAKSSENDRLRLLLKQMCP

SEQ ID NO: 435 - protein, 35 aa, Artificial Sequence
  Core polypeptide
RAKFKQLLQHYREVAAAKSSENDRLRLLLKQMCPS

SEQ ID NO: 436 - protein, 35 aa, Artificial Sequence
  Core polypeptide
AKFKQLLQHYREVAAAKSSENDRLRLLLKQMCPSL

SEQ ID NO: 437 - protein, 35 aa, Artificial Sequence
  Core polypeptide
KFKQLLQHYREVAAAKSSENDRLRLLLKQMCPSLD

SEQ ID NO: 438 - protein, 35 aa, Artificial Sequence
  Core polypeptide
FKQLLQHYREVAAAKSSENDRLRLLLKQMCPSLDV

SEQ ID NO: 439 - protein, 35 aa, Artificial Sequence
  Core polypeptide
KQLLQHYREVAAAKSSENDRLRLLLKQMCPSLDVD

SEQ ID NO: 440 - protein, 35 aa, Artificial Sequence
  Core polypeptide
QLLQHYREVAAAKSSENDRLRLLLKQMCPSLDVDS

SEQ ID NO: 441 - protein, 35 aa, Artificial Sequence
  Core polypeptide
LLQHYREVAAAKSSENDRLRLLLKQMCPSLDVDSI

SEQ ID NO: 442 - protein, 35 aa, Artificial Sequence
  Core polypeptide
LQHYREVAAAKSSENDRLRLLLKQMCPSLDVDSII

SEQ ID NO: 443 - protein, 35 aa, Artificial Sequence
  Core polypeptide
QHYREVAAAKSSENDRLRLLLKQMCPSLDVDSIIP

SEQ ID NO: 444 - protein, 35 aa, Artificial Sequence
  Core polypeptide
HYREVAAAKSSENDRLRLLLKQMCPSLDVDSIIPR

SEQ ID NO: 445 - protein, 35 aa, Artificial Sequence
  Core polypeptide
YREVAAAKSSENDRLRLLLKQMCPSLDVDSIIPRT

SEQ ID NO: 446 - protein, 35 aa, Artificial Sequence
  Core polypeptide
REVAAAKSSENDRLRLLLKQMCPSLDVDSIIPRTP

SEQ ID NO: 447 - protein, 35 aa, Artificial Sequence
  Core polypeptide
EVAAAKSSENDRLRLLLKQMCPSLDVDSIIPRTPD

SEQ ID NO: 448 - protein, 35 aa, Artificial Sequence
  Core polypeptide
VAAAKSSENDRLRLLLKQMCPSLDVDSIIPRTPDV

SEQ ID NO: 449 - protein, 35 aa, Artificial Sequence
  Core polypeptide
AAAKSSENDRLRLLLKQMCPSLDVDSIIPRTPDVL

SEQ ID NO: 450 - protein, 35 aa, Artificial Sequence
  Core polypeptide
AAKSSENDRLRLLLKQMCPSLDVDSIIPRTPDVLH

SEQ ID NO: 451 - protein, 35 aa, Artificial Sequence
  Core polypeptide
AKSSENDRLRLLLKQMCPSLDVDSIIPRTPDVLHE

SEQ ID NO: 452 - protein, 35 aa, Artificial Sequence
  Core polypeptide
KSSENDRLRLLLKQMCPSLDVDSIIPRTPDVLHED

SEQ ID NO: 453 - protein, 35 aa, Artificial Sequence
  Core polypeptide
SSENDRLRLLLKQMCPSLDVDSIIPRTPDVLHEDL

SEQ ID NO: 454 - protein, 35 aa, Artificial Sequence
  Core polypeptide
SENDRLRLLLKQMCPSLDVDSIIPRTPDVLHEDLL

SEQ ID NO: 455 - protein, 35 aa, Artificial Sequence
  Core polypeptide
ENDRLRLLLKQMCPSLDVDSIIPRTPDVLHEDLLN

SEQ ID NO: 456 - protein, 35 aa, Artificial Sequence
  Core polypeptide
NDRLRLLLKQMCPSLDVDSIIPRTPDVLHEDLLNF

SEQ ID NO: 457 - protein, 35 aa, Artificial Sequence
  Core polypeptide
AAGSTMGARSMTLTVQARQLLSGIVQQQNNLLRAI

SEQ ID NO: 458 - protein, 35 aa, Artificial Sequence
  Core polypeptide
PGYRWMCLRRFIIFLFILLLCLIFLLVLLDYQGML

SEQ ID NO: 459 - protein, 35 aa, Artificial Sequence
  Core polypeptide
GYRWMCLRRFIIFLFILLLCLIFLLVLLDYQGMLP

SEQ ID NO: 460 - protein, 35 aa, Artificial Sequence
  Core polypeptide
YRWMCLRRFIIFLFILLLCLIFLLVLLDYQGMLPV

SEQ ID NO: 461 - protein, 35 aa, Artificial Sequence
  Core polypeptide
RWMCLRRFIIFLFILLLCLIFLLVLLDYQGMLPVC

SEQ ID NO: 462 - protein, 35 aa, Artificial Sequence
  Core polypeptide
WMCLRRFIIFLFILLLCLIFLLVLLDYQGMLPVCP

SEQ ID NO: 463 - protein, 35 aa, Artificial Sequence
  Core polypeptide
MCLRRFIIFLFILLLCLIFLLVLLDYQGMLPVCPL

SEQ ID NO: 464 - protein, 35 aa, Artificial Sequence
  Core polypeptide
CLRRFIIFLFILLLCLIFLLVLLDYQGMLPVCPLI

SEQ ID NO: 465 - protein, 35 aa, Artificial Sequence
  Core polypeptide
LRRFIIFLFILLLCLIFLLVLLDYQGMLPVCPLIP

SEQ ID NO: 466 - protein, 35 aa, Artificial Sequence
  Core polypeptide
RRFIIFLFILLLCLIFLLVLLDYQGMLPVCPLIPG

SEQ ID NO: 467 - protein, 35 aa, Artificial Sequence
  Core polypeptide
RFIIFLFILLLCLIFLLVLLDYQGMLPVCPLIPGS

SEQ ID NO: 468 - protein, 35 aa, Artificial Sequence
  Core polypeptide
FIIFLFILLLCLIFLLVLLDYQGMLPVCPLIPGSS

SEQ ID NO: 469 - protein, 35 aa, Artificial Sequence
  Core polypeptide
IIFLFILLLCLIFLLVLLDYQGMLPVCPLIPGSST

SEQ ID NO: 470 - protein, 35 aa, Artificial Sequence
  Core polypeptide
IFLFILLLCLIFLLVLLDYQGMLPVCPLIPGSSTT

SEQ ID NO: 471 - protein, 35 aa, Artificial Sequence
  Core polypeptide
FLFILLLCLIFLLVLLDYQGMLPVCPLIPGSSTTS

SEQ ID NO: 472 - protein, 35 aa, Artificial Sequence
  Core polypeptide
LFILLLCLIFLLVLLDYQGMLPVCPLIPGSSTTST

SEQ ID NO: 473 - protein, 35 aa, Artificial Sequence
  Core polypeptide
FILLLCLIFLLVLLDYQGMLPVCPLIPGSSTTSTG

SEQ ID NO: 474 - protein, 35 aa, Artificial Sequence
  Core polypeptide
ILLLCLIFLLVLLDYQGMLPVCPLIPGSSTTSTGP

SEQ ID NO: 475 - protein, 35 aa, Artificial Sequence
  Core polypeptide
LLLCLIFLLVLLDYQGMLPVCPLIPGSSTTSTGPC

SEQ ID NO: 476 - protein, 35 aa, Artificial Sequence
  Core polypeptide
LLCLIFLLVLLDYQGMLPVCPLIPGSSTTSTGPCR

SEQ ID NO: 477 - protein, 35 aa, Artificial Sequence
  Core polypeptide
LCLIFLLVLLDYQGMLPVCPLIPGSSTTSTGPCRT

SEQ ID NO: 478 - protein, 35 aa, Artificial Sequence
  Core polypeptide
CLIFLLVLLDYQGMLPVCPLIPGSSTTSTGPCRTC

SEQ ID NO: 479 - protein, 35 aa, Artificial Sequence
  Core polypeptide
LIFLLVLLDYQGMLPVCPLIPGSSTTSTGPCRTCM

SEQ ID NO: 480 - protein, 35 aa, Artificial Sequence
  Core polypeptide
IFLLVLLDYQGMLPVCPLIPGSSTTSTGPCRTCMT

SEQ ID NO: 481 - protein, 35 aa, Artificial Sequence
  Core polypeptide
FLLVLLDYQGMLPVCPLIPGSSTTSTGPCRTCMTT

SEQ ID NO: 482 - protein, 35 aa, Artificial Sequence
  Core polypeptide
PLLVLQAGFFLLTRILTIPQSLDSWWTSLNFLGGT

SEQ ID NO: 483 - protein, 35 aa, Artificial Sequence
  Core polypeptide
LLVLQAGFFLLTRILTIPQSLDSWWTSLNFLGGTT

SEQ ID NO: 484 - protein, 35 aa, Artificial Sequence
  Core polypeptide
LVLQAGFFLLTRILTIPQSLDSWWTSLNFLGGTTV

SEQ ID NO: 485 - protein, 35 aa, Artificial Sequence
  Core polypeptide
VLQAGFFLLTRILTIPQSLDSWWTSLNFLGGTTVC

SEQ ID NO: 486 - protein, 35 aa, Artificial Sequence
  Core polypeptide
LQAGFFLLTRILTIPQSLDSWWTSLNFLGGTTVCL

SEQ ID NO: 487 - protein, 35 aa, Artificial Sequence
  Core polypeptide
QAGFFLLTRILTIPQSLDSWWTSLNFLGGTTVCLG

SEQ ID NO: 488 - protein, 35 aa, Artificial Sequence
  Core polypeptide
AGFFLLTRILTIPQSLDSWWTSLNFLGGTTVCLGQ

SEQ ID NO: 489 - protein, 35 aa, Artificial Sequence
  Core polypeptide
GFFLLTRILTIPQSLDSWWTSLNFLGGTTVCLGQN

SEQ ID NO: 490 - protein, 35 aa, Artificial Sequence
  Core polypeptide
FFLLTRILTIPQSLDSWWTSLNFLGGTTVCLGQNS

SEQ ID NO: 491 - protein, 35 aa, Artificial Sequence
  Core polypeptide
FLLTRILTIPQSLDSWWTSLNFLGGTTVCLGQNSQ

SEQ ID NO: 492 - protein, 35 aa, Artificial Sequence
  Core polypeptide
LLTRILTIPQSLDSWWTSLNFLGGTTVCLGQNSQS

SEQ ID NO: 493 - protein, 35 aa, Artificial Sequence
  Core polypeptide
LTRILTIPQSLDSWWTSLNFLGGTTVCLGQNSQSP

SEQ ID NO: 494 - protein, 28 aa, Artificial Sequence
  Core polypeptide
FWNWLSAWKDLELKSLLEEVKDELQKMR

SEQ ID NO: 495 - protein, 19 aa, Artificial Sequence
  Core polypeptide
NNLLRAIEAQQHLLQLTVW

SEQ ID NO: 496 - protein, 41 aa, Artificial Sequence
  Core polypeptide
CGGNNLLRAIEAQQHLLQLTVWGIKQLQARILAVERYLKDQ

SEQ ID NO: 497 - protein, 36 aa, Artificial Sequence; identical to SEQ ID NO: 15
  Core polypeptide

SEQ ID NO: 498 - protein, 36 aa, Artificial Sequence; identical to SEQ ID NO: 15
  Core polypeptide

SEQ ID NO: 499 - protein, 35 aa, Artificial Sequence
  Core polypeptide
AVSKGYLSALRTGWYTSVITIELSNIKENKNGTDA

SEQ ID NO: 500 - protein, 36 aa, Artificial Sequence
  Core polypeptide
SISNIETVIEFQQKNNRLLEITREFSVNAGVTTPVS

SEQ ID NO: 501 - protein, 35 aa, Artificial Sequence
  Core polypeptide
DQQIKQYKRLLDRLIIPLYDGLRQKDVIVSNQESN

SEQ ID NO: 502 - protein, 36 aa, Artificial Sequence
  Core polypeptide
YSELTNIFGDNIGSLQEKGIKLQGIASLYRTNITEI

SEQ ID NO: 503 - protein, 36 aa, Artificial Sequence
  Core polypeptide
TSITLQVRLPLLTRLLNTQIYRVDSISYNIQNREWY

SEQ ID NO: 504 - protein, 35 aa, Artificial Sequence
  Core polypeptide
VEIAEYRRLLRTVLEPIRDALNAMTQNIRPVQSVA

SEQ ID NO: 505 - protein, 36 aa, Artificial Sequence
  Core polypeptide
SYFIVLSIAYPTLSEIKGVIVHRLEGVSYNIGSQEW

SEQ ID NO: 506 - protein, 28 aa, Artificial Sequence
  Core polypeptide
LKEAIRDTNKAVQSVQSSIGNLIVAIKS

SEQ ID NO: 507 - protein, 38 aa, Artificial Sequence; identical to SEQ ID NO: 16
  Core polypeptide

SEQ ID NO: 508 - protein, 16 aa, Artificial Sequence
  Core polypeptide
QKQEPIDKELYPLTSL

SEQ ID NO: 509 - protein, 14 aa, Artificial Sequence
  Core polypeptide
YPKFVKQNTLKLAT

SEQ ID NO: 510 - protein, 14 aa, Artificial Sequence
  Core polypeptide
QYIKANQKFIGITE

SEQ ID NO: 511 - protein, 14 aa, Artificial Sequence
  Core polypeptide
NGQIGNDPNRDILY

SEQ ID NO: 512 - protein, 6 aa, Artificial Sequence
  Core polypeptide
RPDVYH

SEQ ID NO: 513 - protein, 15 aa, Artificial Sequence
  Core polypeptide
CLELDKWASLWNWFC

SEQ ID NO: 514 - protein, 15 aa, Artificial Sequence
  Core polypeptide
CLELDKWASLANWFC

SEQ ID NO: 515 - protein, 15 aa, Artificial Sequence
  Core polypeptide
CLELDKWASLANFFC

SEQ ID NO: 516 - protein, 39 aa, Artificial Sequence
  Core polypeptide
NNLLRAIEAQQQHLLQLTVWGIKQLQARILAVERYLKDQ

SEQ ID NO: 517 - protein, 39 aa, Artificial Sequence
  Core polypeptide
CGGYTSLIHSLIEESQNQQEKNEQELLELDKWASLWNWF

SEQ ID NO: 518 - protein, 35 aa, Artificial Sequence; identical to SEQ ID NO: 482
  Core polypeptide

SEQ ID NO: 519 - protein, 35 aa, Artificial Sequence; identical to SEQ ID NO: 483
  Core polypeptide

SEQ ID NO: 520 - protein, 35 aa, Artificial Sequence; identical to SEQ ID NO: 484
  Core polypeptide

SEQ ID NO: 521 - protein, 35 aa, Artificial Sequence; identical to SEQ ID NO: 485
  Core polypeptide

SEQ ID NO: 522 - protein, 35 aa, Artificial Sequence; identical to SEQ ID NO: 486
  Core polypeptide

SEQ ID NO: 523 - protein, 35 aa, Artificial Sequence; identical to SEQ ID NO: 487
  Core polypeptide

SEQ ID NO: 524 - protein, 35 aa, Artificial Sequence; identical to SEQ ID NO: 488
  Core polypeptide

SEQ ID NO: 525 - protein, 35 aa, Artificial Sequence; identical to SEQ ID NO: 489
  Core polypeptide

SEQ ID NO: 526 - protein, 35 aa, Artificial Sequence; identical to SEQ ID NO: 490
  Core polypeptide

SEQ ID NO: 527 - protein, 35 aa, Artificial Sequence; identical to SEQ ID NO: 491
  Core polypeptide

SEQ ID NO: 528 - protein, 35 aa, Artificial Sequence; identical to SEQ ID NO: 492
  Core polypeptide

SEQ ID NO: 529 - protein, 35 aa, Artificial Sequence; identical to SEQ ID NO: 493
  Core polypeptide

SEQ ID NO: 530 - protein, 13 aa, Artificial Sequence
  Core polypeptide
LELDKWASLWNWA

SEQ ID NO: 531 - protein, 13 aa, Artificial Sequence
  Core polypeptide
LELDKWASAWNWF

SEQ ID NO: 532 - protein, 13 aa, Artificial Sequence
  Core polypeptide
LELDKAASLWNWF

SEQ ID NO: 533 - protein, 13 aa, Artificial Sequence
  Core polypeptide
LKLDKWASLWNWF

SEQ ID NO: 534 - protein, 13 aa, Artificial Sequence
  Core polypeptide
LELKKWASLWNWF

SEQ ID NO: 535 - protein, 13 aa, Artificial Sequence
  Core polypeptide
DELLHNVNAGKST

SEQ ID NO: 536 - protein, 15 aa, Artificial Sequence
  Core polypeptide
KSDELLHNVNAGKST

SEQ ID NO: 537 - protein, 17 aa, Artificial Sequence
  Core polypeptide
IRKSDELLHNVNAGKST

SEQ ID NO: 538 - protein, 19 aa, Artificial Sequence
  Core polypeptide
AFIRKSDELLHNVNAGKST

SEQ ID NO: 539 - protein, 19 aa, Artificial Sequence
  Core polypeptide
FDASISQVNEKINQSLAFI

SEQ ID NO: 540 - protein, 36 aa, Artificial Sequence
  Core polypeptide
YAADKESTQKAFDGITNKVNSVIEKMNTQFEAVGKE

SEQ ID NO: 541 - protein, 36 aa, Artificial Sequence
  Core polypeptide
SVIEKMNTQFEAVGKEFGNLERRLENLNKRMEDGFL

SEQ ID NO: 542 - protein, 36 aa, Artificial Sequence
  Core polypeptide
VWTYNAELLVLMENERTLDFHDSNVKNLYDKVRMQL

SEQ ID NO: 543 - protein, 33 aa, Artificial Sequence
  Core polypeptide
EWDREINNYTSLIHSLIEESQNQQEKNEQEGGC

SEQ ID NO: 544 - protein, 35 aa, Artificial Sequence
  Core polypeptide
INNYTSLIHSLIEESQNQQEKNEQELLELDKWASL

SEQ ID NO: 545 - protein, 28 aa, Artificial Sequence
  Core polypeptide
INNYTSLIHSLIEESQNQQEKNEQELLE

SEQ ID NO: 546 - protein, 35 aa, Artificial Sequence
  Core polypeptide
WMEWDREINNYTSLIHSLIEESQNQQEKNEQELLE

SEQ ID NO: 547 - protein, 48 aa, Artificial Sequence
  Core polypeptide
MTWMEWDREINNYTSLIHSLIEESQNQQEKNEQELLELDKWASLWNWF

SEQ ID NO: 548 - protein, 35 aa, Artificial Sequence
  Core polypeptide
IDISIELNKAKSDLEESKEWIKKSNQKLDSIGNWH

SEQ ID NO: 549 - protein, 36 aa, Artificial Sequence
  Core polypeptide
NQQEKNEQELLELDKWASLWNWFNITNWLWYIKIFI

SEQ ID NO: 550 - protein, 36 aa, Artificial Sequence
  Core polypeptide
QNQQEKNEQELLELDKWASLWNWFNITNWLWYIKIF

SEQ ID NO: 551 - protein, 36 aa, Artificial Sequence
  Core polypeptide
SQNQQEKNEQELLELDKWASLWNWFNITNWLWYIKI

SEQ ID NO: 552 - protein, 36 aa, Artificial Sequence
  Core polypeptide
ESQNQQEKNEQELLELDKWASLWNWFNITNWLWYIK

SEQ ID NO: 553 - protein, 36 aa, Artificial Sequence
  Core polypeptide
EESQNQQEKNEQELLELDKWASLWNWFNITNWLWYI

SEQ ID NO: 554 - protein, 36 aa, Artificial Sequence
  Core polypeptide
IEESQNQQEKNEQELLELDKWASLWNWFNITNWLWY

SEQ ID NO: 555 - protein, 36 aa, Artificial Sequence
  Core polypeptide
LIEESQNQQEKNEQELLELDKWASLWNWFNITNWLW

SEQ ID NO: 556 - protein, 36 aa, Artificial Sequence
  Core polypeptide
SLIEESQNQQEKNEQELLELDKWASLWNWFNITNWL

SEQ ID NO: 557 - protein, 36 aa, Artificial Sequence
  Core polypeptide
HSLIEESQNQQEKNEQELLELDKWASLWNWFNITNW

SEQ ID NO: 558 - protein, 36 aa, Artificial Sequence
  Core polypeptide
IHSLIEESQNQQEKNEQELLELDKWASLWNWFNITN

SEQ ID NO: 559 - protein, 36 aa, Artificial Sequence
  Core polypeptide
LIHSLIEESQNQQEKNEQELLELDKWASLWNWFNIT

SEQ ID NO: 560 - protein, 36 aa, Artificial Sequence
  Core polypeptide
SLIHSLIEESQNQQEKNEQELLELDKWASLWNWFNI

SEQ ID NO: 561 - protein, 36 aa, Artificial Sequence
  Core polypeptide
TSLIHSLIEESQNQQEKNEQELLELDKWASLWNWFN

SEQ ID NO: 562 - protein, 36 aa, Artificial Sequence
  Core polypeptide
NYTSLIHSLIEESQNQQEKNEQELLELDKWASLWNW

SEQ ID NO: 563 - protein, 36 aa, Artificial Sequence
  Core polypeptide
NNYTSLIHSLIEESQNQQEKNEQELLELDKWASLWN

SEQ ID NO: 564 - protein, 36 aa, Artificial Sequence
  Core polypeptide
INNYTSLIHSLIEESQNQQEKNEQELLELDKWASLW

SEQ ID NO: 565 - protein, 36 aa, Artificial Sequence
  Core polypeptide
EINNYTSLIHSLIEESQNQQEKNEQELLELDKWASL

SEQ ID NO: 566 - protein, 36 aa, Artificial Sequence
  Core polypeptide
REINNYTSLIHSLIEESQNQQEKNEQELLELDKWAS

SEQ ID NO: 567 - protein, 36 aa, Artificial Sequence
  Core polypeptide
DREINNYTSLIHSLIEESQNQQEKNEQELLELDKWA

SEQ ID NO: 568 - protein, 36 aa, Artificial Sequence
  Core polypeptide
WDREINNYTSLIHSLIEESQNQQEKNEQELLELDKW

SEQ ID NO: 569 - protein, 36 aa, Artificial Sequence
  Core polypeptide
EWDREINNYTSLIHSLIEESQNQQEKNEQELLELDK

SEQ ID NO: 570 - protein, 38 aa, Artificial Sequence
  Core polypeptide
MEWDREINNYTSLIHSLIEESQNQQEKNEQELLELDNH

SEQ ID NO: 571 - protein, 36 aa, Artificial Sequence
  Core polypeptide
MEWDREINNYTSLIHSLIEESQNQQEKNEQELLELD

SEQ ID NO: 572 - protein, 36 aa, Artificial Sequence
  Core polypeptide
WMEWDREINNYTSLIHSLIEESQNQQEKNEQELLEL

SEQ ID NO: 573 - protein, 36 aa, Artificial Sequence
  Core polypeptide
TWMEWDREINNYTSLIHSLIEESQNQQEKNEQELLE

SEQ ID NO: 574 - protein, 36 aa, Artificial Sequence
  Core polypeptide
MTWMEWDREINNYTSLIHSLIEESQNQQEKNEQELL

SEQ ID NO: 575 - protein, 36 aa, Artificial Sequence
  Core polypeptide
NMTWMEWDREINNYTSLIHSLIEESQNQQEKNEQEL

SEQ ID NO: 576 - protein, 36 aa, Artificial Sequence
  Core polypeptide
NNMTWMEWDREINNYTSLIHSLIEESQNQQEKNEQE

SEQ ID NO: 577 - protein, 36 aa, Artificial Sequence
  Core polypeptide
WNNMTWMEWDREINNYTSLIHSLIEESQNQQEKNEQ

SEQ ID NO: 578 - protein, 36 aa, Artificial Sequence
  Core polypeptide
IWNNMTWMEWDREINNYTSLIHSLIEESQNQQEKNE

SEQ ID NO: 579 - protein, 36 aa, Artificial Sequence
  Core polypeptide
QIWNNMTWMEWDREINNYTSLIHSLIEESQNQQEKN

SEQ ID NO: 580 - protein, 36 aa, Artificial Sequence
  Core polypeptide
EQIWNNMTWMEWDREINNYTSLIHSLIEESQNQQEK

SEQ ID NO: 581 - protein, 36 aa, Artificial Sequence
  Core polypeptide
LEQIWNNMTWMEWDREINNYTSLIHSLIEESQNQQE

SEQ ID NO: 582 - protein, 36 aa, Artificial Sequence
  Core polypeptide
SLEQIWNNMTWMEWDREINNYTSLIHSLIEESQNQQ

SEQ ID NO: 583 - protein, 36 aa, Artificial Sequence
  Core polypeptide
KSLEQIWNNMTWMEWDREINNYTSLIHSLIEESQNQ

SEQ ID NO: 584 - protein, 36 aa, Artificial Sequence
  Core polypeptide
NKSLEQIWNNMTWMEWDREINNYTSLIHSLIEESQN

SEQ ID NO: 585 - protein, 21 aa, Artificial Sequence
  Core polypeptide
SLAFIRKSDELLHNVNAGKST

SEQ ID NO: 586 - protein, 21 aa, Artificial Sequence
  Core polypeptide
FDASISQVNEKINQSLAFIRK

SEQ ID NO: 587 - protein, 36 aa, Artificial Sequence
  Core polypeptide
YTSLIHSLIEESQQQQEKQEQELLELDKWASLWNWF

SEQ ID NO: 588 - protein, 33 aa, Artificial Sequence
  Core polypeptide
FDASISQVNEKINQSLAFIRKSDELLHNVNAGK

SEQ ID NO: 589 - protein, 31 aa, Artificial Sequence
  Core polypeptide
FDASISQVNEKINQSLAFIRKSDELLHNVNA

SEQ ID NO: 590 - protein, 29 aa, Artificial Sequence
  Core polypeptide
FDASISQVNEKINQSLAFIRKSDELLHNV

SEQ ID NO: 591 - protein, 27 aa, Artificial Sequence
  Core polypeptide
FDASISQVNEKINQSLAFIRKSDELLH

SEQ ID NO: 592 - protein, 25 aa, Artificial Sequence
  Core polypeptide
FDASISQVNEKINQSLAFIRKSDEL

SEQ ID NO: 593 - protein, 23 aa, Artificial Sequence
  Core polypeptide
FDASISQVNEKINQSLAFIRKSD

SEQ ID NO: 594 - protein, 33 aa, Artificial Sequence
  Core polypeptide
ASISQVNEKINQSLAFIRKSDELLHNVNAGKST

SEQ ID NO: 595 - protein, 31 aa, Artificial Sequence
  Core polypeptide
ISQVNEKINQSLAFIRKSDELLHNVNAGKST

SEQ ID NO: 596 - protein, 29 aa, Artificial Sequence
  Core polypeptide
QVNEKINQSLAFIRKSDELLHNVNAGKST

SEQ ID NO: 597 - protein, 27 aa, Artificial Sequence
  Core polypeptide
NEKINQSLAFIRKSDELLHNVNAGKST

SEQ ID NO: 598 - protein, 25 aa, Artificial Sequence
  Core polypeptide
KINQSLAFIRKSDELLHNVNAGKST

SEQ ID NO: 599 - protein, 23 aa, Artificial Sequence
  Core polypeptide
NQSLAFIRKSDELLHNVNAGKST

SEQ ID NO: 600 - protein, 30 aa, Artificial Sequence
  Core polypeptide
FWNWLSAWKDLELYPGSLELDKWASLWNWF

SEQ ID NO: 601 - protein, 41 aa, Artificial Sequence; identical to SEQ ID NO: 496
  Core polypeptide

SEQ ID NO: 602 - protein, 39 aa, Artificial Sequence; identical to SEQ ID NO: 517
  Core polypeptide

SEQ ID NO: 603 - protein, 36 aa, Artificial Sequence; identical to SEQ ID NO: 15
  Core polypeptide

SEQ ID NO: 604 - protein, 38 aa, Artificial Sequence; identical to SEQ ID NO: 16
  Core polypeptide

SEQ ID NO: 605 - protein, 36 aa, Artificial Sequence
  Core polypeptide
EKNMYELQKLNSWDVFTNWLDFTSWVRYIQYIQYGV

SEQ ID NO: 606 - protein, 36 aa, Artificial Sequence
  Core polypeptide
QEKNMYELQKLNSWDVFTNWLDFTSWVRYIQYIQYG

SEQ ID NO: 607 - protein, 36 aa, Artificial Sequence
  Core polypeptide
QQEKNMYELQKLNSWDVFTNWLDFTSWVRYIQYIQY

SEQ ID NO: 608 - protein, 36 aa, Artificial Sequence
  Core polypeptide
IQQEKNMYELQKLNSWDVFTNWLDFTSWVRYIQYIQ

SEQ ID NO: 609 - protein, 36 aa, Artificial Sequence
  Core polypeptide
QIQQEKNMYELQKLNSWDVFTNWLDFTSWVRYIQYI

SEQ ID NO: 610 - protein, 36 aa, Artificial Sequence
  Core polypeptide
AQIQQEKNMYELQKLNSWDVFTNWLDFTSWVRYIQY

SEQ ID NO: 611 - protein, 36 aa, Artificial Sequence
  Core polypeptide
QAQIQQEKNMYELQKLNSWDVFTNWLDFTSWVRYIQ

SEQ ID NO: 612 - protein, 36 aa, Artificial Sequence
  Core polypeptide
EQAQIQQEKNMYELQKLNSWDVFTNWLDFTSWVRYI

SEQ ID NO: 613 - protein, 36 aa, Artificial Sequence
  Core polypeptide
LEQAQIQQEKNMYELQKLNSWDVFTNWLDFTSWVRY

SEQ ID NO: 614 - protein, 36 aa, Artificial Sequence
  Core polypeptide
SLEQAQIQQEKNMYELQKLNSWDVFTNWLDFTSWVR

SEQ ID NO: 615 - protein, 36 aa, Artificial Sequence
  Core polypeptide
QSLEQAQIQQEKNMYELQKLNSWDVFTNWLDFTSWV

SEQ ID NO: 616 - protein, 36 aa, Artificial Sequence
  Core polypeptide
SQSLEQAQIQQEKNMYELQKLNSWDVFTNWLDFTSW

SEQ ID NO: 617 - protein, 36 aa, Artificial Sequence
  Core polypeptide
ISQSLEQAQIQQEKNMYELQKLNSWDVFTNWLDFTS

SEQ ID NO: 618 - protein, 36 aa, Artificial Sequence
  Core polypeptide
NISQSLEQAQIQQEKNMYELQKLNSWDVFTNWLDFT

SEQ ID NO: 619 - protein, 36 aa, Artificial Sequence
  Core polypeptide
ANISQSLEQAQIQQEKNMYELQKLNSWDVFTNWLDF

SEQ ID NO: 620 - protein, 36 aa, Artificial Sequence
  Core polypeptide
EANISQSLEQAQIQQEKNMYELQKLNSWDVFTNWLD

SEQ ID NO: 621 - protein, 36 aa, Artificial Sequence
  Core polypeptide
LEANISQSLEQAQIQQEKNMYELQKLNSWDVFTNWL

SEQ ID NO: 622 - protein, 36 aa, Artificial Sequence
  Core polypeptide
YLEANISQSLEQAQIQQEKNMYELQKLNSWDVFTNW

SEQ ID NO: 623 - protein, 23 aa, Artificial Sequence
  Core polypeptide
YTSLIHSLIEESQNQQEKNEQEL

SEQ ID NO: 624 - protein, 36 aa, Artificial Sequence
  Core polypeptide
YTSLIHSLIEESQNLQEKNEQELLELDKWASLWNWF

SEQ ID NO: 625 - protein, 36 aa, Artificial Sequence
  Core polypeptide
YTSLIHSLIEESQNQQEKLEQELLELDKWASLWNWF

SEQ ID NO: 626 - protein, 36 aa, Artificial Sequence
  Core polypeptide
YTSLIHSLIEESQNQQEKNEQELLEFDKWASLWNWF

SEQ ID NO: 627 - protein, 36 aa, Artificial Sequence
  Core polypeptide
YTSLIHSLIEESQNQQEKNEQELLELDKPASLWNWF

SEQ ID NO: 628 - protein, 36 aa, Artificial Sequence
  Core polypeptide
YTSLIHSLIEESQNQQEKNEQELLELDKWASPWNWF

SEQ ID NO: 629 - protein, 36 aa, Artificial Sequence
  Core polypeptide
YTSLIHSLIEESQNQQEKNEQELLELDKWASLWNSF

SEQ ID NO: 630 - protein, 36 aa, Artificial Sequence; identical to SEQ ID NO: 15
  Core polypeptide

SEQ ID NO: 631 - protein, 36 aa, Artificial Sequence; identical to SEQ ID NO: 15
  Core polypeptide

SEQ ID NO: 632 - protein, 39 aa, Artificial Sequence
  Core polypeptide
FMCYTSLIHSLIEESQNQQEKNEQELLELDKWASLWNWF

SEQ ID NO: 633 - protein, 41 aa, Artificial Sequence
  Core polypeptide
FMCNNLLRAIEAQQHLLQLTVWGIKQLQARILAVERYLKDQ

SEQ ID NO: 634 - protein, 30 aa, Artificial Sequence
  Core polypeptide
EWDREINNYTSLIHSLIEESQNQQEKNEQE

SEQ ID NO: 635 - protein, 29 aa, Artificial Sequence
  Core polypeptide
LIEESQNQQEKNEQELLELDKWASLWNWF

SEQ ID NO: 636 - protein, 35 aa, Artificial Sequence
  Core polypeptide
FWNWLSAWKDLELGGPGSGPGGLELDKWASLWNWF

SEQ ID NO: 637 - protein, 29 aa, Artificial Sequence
  Core polypeptide
LIHSLIEESQNQQEKNEQELLELDKWASL

SEQ ID NO: 638 - protein, 35 aa, Artificial Sequence
  Core polypeptide
TSLIHSLIEESQNQQEKNEQELLELDKWASLWNWF

SEQ ID NO: 639 - protein, 33 aa, Artificial Sequence; identical to SEQ ID NO: 61
  Core polypeptide

SEQ ID NO: 640 - protein, 41 aa, Artificial Sequence
  Core polypeptide
GGGGGYTSLIHSLIEESQNQQEKNEQELLELDKWASLWNWF

SEQ ID NO: 641 - protein, 31 aa, Artificial Sequence
  Core polypeptide
HSLIEESQNQQEKNEQELLELDKWASLWNWF

SEQ ID NO: 642 - protein, 36 aa, Artificial Sequence
  Core polypeptide
YTSLIYSLIEESQNQQEKNEQELLELDKWASLWNWF

SEQ ID NO: 643 - protein, 36 aa, Artificial Sequence
  Core polypeptide
YTSLIHSLIEKSQNQQEKNEQELLELDKWASLWNWF

SEQ ID NO: 644 - protein, 36 aa, Artificial Sequence
  Core polypeptide
YTSLIHSSIEESQNQQEKNEQELLELDKWASLWNWF

SEQ ID NO: 645 - protein, 36 aa, Artificial Sequence
  Core polypeptide
LEANISQLLEQAQIQQEKNMYELQKLNSWDVFTNWL

SEQ ID NO: 646 - protein, 35 aa, Artificial Sequence
  Core polypeptide
SLEECDSELEIKRYKNRVASRKCRAKFKQLLQHYR

SEQ ID NO: 647 - protein, 35 aa, Artificial Sequence
  Core polypeptide
LEECDSELEIKRYKNRVASRKCRAKFKQLLQHYRE

SEQ ID NO: 648 - protein, 35 aa, Artificial Sequence
  Core polypeptide
EECDSELEIKRYKNRVASRKCRAKFKQLLQHYREV

SEQ ID NO: 649 - protein, 35 aa, Artificial Sequence
  Core polypeptide
ECDSELEIKRYKNRVASRKCRAKFKQLLQHYREVA

SEQ ID NO: 650 - protein, 35 aa, Artificial Sequence
  Core polypeptide
CDSELEIKRYKNRVASRKCRAKFKQLLQHYREVAA

SEQ ID NO: 651 - protein, 35 aa, Artificial Sequence
  Core polypeptide
DSELEIKRYKNRVASRKCRAKFKQLLQHYREVAAA

SEQ ID NO: 652 - protein, 49 aa, Artificial Sequence
  Core polypeptide
DESAMINTYRSINEFDASISQVNEKINQSLAFIRKSDELLHNVNAGKST

SEQ ID NO: 653 - protein, 7 aa, Artificial Sequence
  Core polypeptide
WASLWNW

SEQ ID NO: 654 - protein, 38 aa, Artificial Sequence
  Core polypeptide
EAQQHLLQLTVWGIKQLQARILAVERYLKDQQLLGIWG

SEQ ID NO: 655 - protein, 38 aa, Artificial Sequence
  Core polypeptide
IEAQQHLLQLTVWGIKQLQARILAVERYLKDQQLLGIW

SEQ ID NO: 656 - protein, 38 aa, Artificial Sequence
  Core polypeptide
AIEAQQHLLQLTVWGIKQLQARILAVERYLKDQQLLGI

SEQ ID NO: 657 - protein, 38 aa, Artificial Sequence
  Core polypeptide
RAIEAQQHLLQLTVWGIKQLQARILAVERYLKDQQLLG

SEQ ID NO: 658 - protein, 38 aa, Artificial Sequence
  Core polypeptide
LRAIEAQQHLLQLTVWGIKQLQARILAVERYLKDQQLL

SEQ ID NO: 659 - protein, 38 aa, Artificial Sequence
  Core polypeptide
LLRAIEAQQHLLQLTVWGIKQLQARILAVERYLKDQQL

SEQ ID NO: 660 - protein, 38 aa, Artificial Sequence
  Core polypeptide
NLLRAIEAQQHLLQLTVWGIKQLQARILAVERYLKDQQ

SEQ ID NO: 661 - protein, 38 aa, Artificial Sequence
  Core polypeptide
QNNLLRAIEAQQHLLQLTVWGIKQLQARILAVERYLKD

SEQ ID NO: 662 - protein, 38 aa, Artificial Sequence
  Core polypeptide
QQNNLLRAIEAQQHLLQLTVWGIKQLQARILAVERYLK

SEQ ID NO: 663 - protein, 38 aa, Artificial Sequence
  Core polypeptide
QQQNNLLRAIEAQQHLLQLTVWGIKQLQARILAVERYL

SEQ ID NO: 664 - protein, 38 aa, Artificial Sequence
  Core polypeptide
VQQQNNLLRAIEAQQHLLQLTVWGIKQLQARILAVERY

SEQ ID NO: 665 - protein, 38 aa, Artificial Sequence
  Core polypeptide
IVQQQNNLLRAIEAQQHLLQLTVWGIKQLQARILAVER

SEQ ID NO: 666 - protein, 38 aa, Artificial Sequence
  Core polypeptide
GIVQQQNNLLRAIEAQQHLLQLTVWGIKQLQARILAVE

SEQ ID NO: 667 - protein, 38 aa, Artificial Sequence
  Core polypeptide
SGIVQQQNNLLRAIEAQQHLLQLTVWGIKQLQARILAV

SEQ ID NO: 668 - protein, 38 aa, Artificial Sequence
  Core polypeptide
RSMTLTVQARQLLSGIVQQQNNLLRAIEAQQHLLQLTV

SEQ ID NO: 669 - protein, 38 aa, Artificial Sequence
  Core polypeptide
GARSMTLTVQARQLLSGIVQQQNNLLRAIEAQQHLLQL

SEQ ID NO: 670 - protein, 38 aa, Artificial Sequence
  Core polypeptide
GSTMGARSMTLTVQARQLLSGIVQQQNNLLRAIEAQQH

SEQ ID NO: 671 - protein, 38 aa, Artificial Sequence; identical to SEQ ID NO: 670
  Core polypeptide

SEQ ID NO: 672 - protein, 38 aa, Artificial Sequence
  Core polypeptide
EGSTMGARSMTLTVQARQLLSGIVQQQNNLLRAIEAQQ

SEQ ID NO: 673 - protein, 28 aa, Artificial Sequence
  Core polypeptide
RAKFKQLLQHYREVAAAKSSENDRLRLL

SEQ ID NO: 674 - protein, 28 aa, Artificial Sequence
  Core polypeptide
AKFKQLLQHYREVAAAKSSENDRLRLLL

SEQ ID NO: 675 - protein, 28 aa, Artificial Sequence
  Core polypeptide
KFKQLLQHYREVAAAKSSENDRLRLLLK

SEQ ID NO: 676 - protein, 28 aa, Artificial Sequence
  Core polypeptide
FKQLLQHYREVAAAKSSENDRLRLLLKQ

SEQ ID NO: 677 - protein, 35 aa, Artificial Sequence
  Core polypeptide
RAKFKQELQHYREVAAAKSSENDRLRLLLKQMCPS

SEQ ID NO: 678 - protein, 10 aa, Artificial Sequence
  Core polypeptide
DKWASLWNWF

SEQ ID NO: 679 - protein, 35 aa, Artificial Sequence; identical to SEQ ID NO: 114
  Core polypeptide

SEQ ID NO: 680 - protein, 35 aa, Artificial Sequence
  Core polypeptide
YDASISQVNEKINQSLAFIRKSDELLHNVNAGKST

SEQ ID NO: 681 - protein, 35 aa, Artificial Sequence
  Core polypeptide
YDASISQVNEKINQSLAYIRKSDELLHNVNAGKST

SEQ ID NO: 682 - protein, 35 aa, Artificial Sequence
  Core polypeptide
FDASISQVNEKINQSLAYIRKSDELLHNVNAGKST

SEQ ID NO: 683 - protein, 35 aa, Artificial Sequence
  Core polypeptide
FDASISQVQEKIQQSLAFIRKSDELLHQVQAGKST

SEQ ID NO: 684 - protein, 35 aa, Artificial Sequence
  Core polypeptide
FDASISQVNEKINQALAFIRKADELLHNVNAGKST

SEQ ID NO: 685 - protein, 35 aa, Artificial Sequence
  Core polypeptide
FDASISQVNEKINQALAFIRKSDELLHNVNAGKST

SEQ ID NO: 686 - protein, 35 aa, Artificial Sequence
  Core polypeptide
FDASISQVNEKINQSLAFIRKADELLHNVNAGKST

SEQ ID NO: 687 - protein, 35 aa, Artificial Sequence
  Core polypeptide
YDASISQVQEEIQQALAFIRKADELLEQVQAGKST

SEQ ID NO: 688 - protein, 35 aa, Artificial Sequence
  Core polypeptide
FDASISQVNEKINQSLAFIRKSDELLENVNAGKST

SEQ ID NO: 689 - protein, 35 aa, Artificial Sequence
  Core polypeptide
FDASISQVNEEINQSLAFIRKSDELLHNVNAGKST

SEQ ID NO: 690 - protein, 35 aa, Artificial Sequence
  Core polypeptide
VFPSDEFDASISQVNEKINQSLAFIRKSDELLENV

SEQ ID NO: 691 - protein, 35 aa, Artificial Sequence
  Core polypeptide
VFPSDEFDASISQVNEEINQSLAFIRKSDELLENV

SEQ ID NO: 692 - protein, 35 aa, Artificial Sequence
  Core polypeptide
VYPSDEYDASISQVNEEINQALAYIRKADELLENV

SEQ ID NO: 693 - protein, 35 aa, Artificial Sequence
  Core polypeptide
VFPSDEFDASISQVNEEINQSLAFIRKSDELLHNV

SEQ ID NO: 694 - protein, 36 aa, Artificial Sequence
  Core polypeptide
SNKSLEQIWNNMTWMEWDREINNYTSLIHSLIEESQ

SEQ ID NO: 695 - protein, 36 aa, Artificial Sequence
  Core polypeptide
WSNKSLEQIWNNMTWMEWDREINNYTSLIHSLIEES

SEQ ID NO: 696 - protein, 36 aa, Artificial Sequence
  Core polypeptide
SWSNKSLEQIWNNMTWMEWDREINNYTSLIHSLIEE

SEQ ID NO: 697 - protein, 36 aa, Artificial Sequence
  Core polypeptide
ASWSNKSLEQIWNNMTWMEWDREINNYTSLIHSLIE

SEQ ID NO: 698 - protein, 36 aa, Artificial Sequence
  Core polypeptide
NASWSNKSLEQIWNNMTWMEWDREINNYTSLIHSLI

SEQ ID NO: 699 - protein, 36 aa, Artificial Sequence
  Core polypeptide
WNASWSNKSLEQIWNNMTWMEWDREINNYTSLIHSL

SEQ ID NO: 700 - protein, 36 aa, Artificial Sequence
  Core polypeptide
PWNASWSNKSLEQIWNNMTWMEWDREINNYTSLIHS

SEQ ID NO: 701 - protein, 36 aa, Artificial Sequence
  Core polypeptide
VPWNASWSNKSLEQIWNNMTWMEWDREINNYTSLIH

SEQ ID NO: 702 - protein, 36 aa, Artificial Sequence
  Core polypeptide
AVPWNASWSNKSLEQIWNNMTWMEWDREINNYTSLI

SEQ ID NO: 703 - protein, 36 aa, Artificial Sequence
  Core polypeptide
TAVPWNASWSNKSLEQIWNNMTWMEWDREINNYTSL

SEQ ID NO: 704 - protein, 36 aa, Artificial Sequence
  Core polypeptide
TTAVPWNASWSNKSLEQIWNNMTWMEWDREINNYTS

SEQ ID NO: 705 - protein, 36 aa, Artificial Sequence; identical to SEQ ID NO: 15
  Core polypeptide

SEQ ID NO: 706 - protein, 35 aa, Artificial Sequence
  Core polypeptide
AAASDEFDASISQVNEKINQSLAFIRKSDELLHNV

SEQ ID NO: 707 - protein, 35 aa, Artificial Sequence
  Core polypeptide
VFPAAAFDASISQVNEKINQSLAFIRKSDELLHNV

SEQ ID NO: 708 - protein, 35 aa, Artificial Sequence
  Core polypeptide
VFPSDEAAASISQVNEKINQSLAFIRKSDELLHNV

SEQ ID NO: 709 - protein, 35 aa, Artificial Sequence
  Core polypeptide
VFPSDEFDAAAAQVNEKINQSLAFIRKSDELLHNV

SEQ ID NO: 710 - protein, 35 aa, Artificial Sequence
  Core polypeptide
VFPSDEFDASISAAAEKINQSLAFIRKSDELLHNV

SEQ ID NO: 711 - protein, 35 aa, Artificial Sequence
  Core polypeptide
VFPSDEFDASISQVNAAANQSLAFIRKSDELLHNV

SEQ ID NO: 712 - protein, 35 aa, Artificial Sequence
  Core polypeptide
VFPSDEFDASISQVNEKIAAALAFIRKSDELLHNV

SEQ ID NO: 713 - protein, 35 aa, Artificial Sequence
  Core polypeptide
VFPSDEFDASISQVNEKINQSAAAIRKSDELLHNV

SEQ ID NO: 714 - protein, 35 aa, Artificial Sequence
  Core polypeptide
VFPSDEFDASISQVNEKINQSLAFAAASDELLHNV

SEQ ID NO: 715 - protein, 35 aa, Artificial Sequence
  Core polypeptide
VFPSDEFDASISQVNEKINQSLAFIRKAAALLHNV

SEQ ID NO: 716 - protein, 35 aa, Artificial Sequence
  Core polypeptide
VFPSDEFDASISQVNEKINQSLAFIRKSDEAAANV

SEQ ID NO: 717 - protein, 35 aa, Artificial Sequence
  Core polypeptide
VFPSDEFDASISQVNEKINQSLAFIRKSDELLAAA

SEQ ID NO: 718 - protein, 35 aa, Artificial Sequence
  Core polypeptide
VYPSDEFDASISQVNEKINQSLAFIRKSDELLHNV

SEQ ID NO: 719 - protein, 36 aa, Artificial Sequence
  Core polypeptide
AAAAIHSLIEESQNQQEKNEQELLELDKWASLWNWF

SEQ ID NO: 720 - protein, 36 aa, Artificial Sequence
  Core polypeptide
YTSLIHSLIEESQQQQEKNEQELLELDKWASLWNWF

SEQ ID NO: 721 - protein, 36 aa, Artificial Sequence
  Core polypeptide
YTSLIHSLIEESQNQQEKQEQELLELDKWASLWNWF

SEQ ID NO: 722 - protein, 36 aa, Artificial Sequence
  Core polypeptide
QIWNNMTWMEWDREINNYTSLIHSLIEESQNQQEKQ

SEQ ID NO: 723 - protein, 36 aa, Artificial Sequence
  Core polypeptide
QIWNNMTWMEWDREINNYTSLIHSLIEESQQQQEKN

SEQ ID NO: 724 - protein, 36 aa, Artificial Sequence
  Core polypeptide
QIWNNMTWMEWDREINNYTSLIHSLIEESQQQQEKQ

SEQ ID NO: 725 - protein, 36 aa, Artificial Sequence
  Core polypeptide
NKSLEQIWNNMTWMEWDREINNYTSLIHSLIEESQQ

SEQ ID NO: 726 - protein, 35 aa, Artificial Sequence
  Core polypeptide
FDASISQVNEKINQSLAFIEESDELLHNVNAGKST

SEQ ID NO: 727 - protein, 9 aa, Artificial Sequence
  Core polypeptide
IRKSDELCL

SEQ ID NO: 728 - protein, 36 aa, Artificial Sequence
  Core polypeptide
YTSLIHSLIEESQNQQEKDEQELLELDKWASLWNWF

SEQ ID NO: 729 - protein, 36 aa, Artificial Sequence
  Core polypeptide
YTSLIHSLIEESQDQQEKNEQELLELDKWASLWNWF

SEQ ID NO: 730 - protein, 36 aa, Artificial Sequence
  Core polypeptide
YTSLIHSLIEESQDQQEKDEQELLELDKWASLWNWF

SEQ ID NO: 731 - protein, 36 aa, Artificial Sequence
  Core polypeptide
YTSLIHSLIEESQNQQEKNEQELLELDKWASLWDWF

SEQ ID NO: 732 - protein, 36 aa, Artificial Sequence
  Core polypeptide
LEANITQSLEQAQIQQEKNMYELQKLNSWDVFTNWL

SEQ ID NO: 733 - protein, 36 aa, Artificial Sequence
  Core polypeptide
LEANISASLEQAQIQQEKNMYELQKLNSWDVFTNWL

SEQ ID NO: 734 - protein, 36 aa, Artificial Sequence
  Core polypeptide
LEANISALLEQAQIQQEKNMYELQKLNSWDVFTNWL

SEQ ID NO: 735 - protein, 36 aa, Artificial Sequence
  Core polypeptide
LEANITALLEQAQIQQEKNMYELQKLNSWDVFTNWL

SEQ ID NO: 736 - protein, 36 aa, Artificial Sequence
  Core polypeptide
LEANITASLEQAQIQQEKNMYELQKLNSWDVFTNWL

SEQ ID NO: 737 - protein, 34 aa, Artificial Sequence
  Core polypeptide
RAKFKQLLQHYREVAAAKSSENDRLRLLLKQMPS

SEQ ID NO: 738 - protein, 30 aa, Artificial Sequence
  Core polypeptide
MNSVKNGTYDYPKYEEESKLNRNEIKGVKL

SEQ ID NO: 739 - protein, 36 aa, Artificial Sequence
  Core polypeptide
WQEWEQKVRYLEANISQSLEQAQIQQEKNMYELQKL

SEQ ID NO: 740 - protein, 35 aa, Artificial Sequence
  Core polypeptide
DEYDASISQVNEKINQSLAFIRKSDELLHNVNAGK

SEQ ID NO: 741 - protein, 34 aa, Artificial Sequence
  Core polypeptide
YTSLIHSLIEESQNQQEKNEQELLELDKWASLWN

SEQ ID NO: 742 - protein, 33 aa, Artificial Sequence
  Core polypeptide
YTSLIHSLIEESQNQQEKNEQELLELDKWASLW

SEQ ID NO: 743 - protein, 32 aa, Artificial Sequence
  Core polypeptide
YTSLIHSLIEESQNQQEKNEQELLELDKWASL

SEQ ID NO: 744 - protein, 31 aa, Artificial Sequence
  Core polypeptide
YTSLIHSLIEESQNQQEKNEQELLELDKWAS

SEQ ID NO: 745 - protein, 51 aa, Artificial Sequence
  Core polypeptide
QARQLLSGIVQQQNNLLRAIEAQQHLLQLTVWGIKQLQARILAVERYLKDQ

SEQ ID NO: 746 - protein, 42 aa, Artificial Sequence
  Core polypeptide
DREINNYTSLIHSLIEESQNQQEKNEQELLELDKWASLWNWF

SEQ ID NO: 747 - protein, 42 aa, Artificial Sequence
  Core polypeptide
NNMTWMEWDREINNYTSLIHSLIEESQNQQEKNEQELLELDK

SEQ ID NO: 748 - protein, 36 aa, Artificial Sequence
  Core polypeptide
YTSLIHSLIEESQNQQEKNEQELLELDKWASLWAAA

SEQ ID NO: 749 - protein, 36 aa, Artificial Sequence
  Core polypeptide
YTSLIHSLIEESQNQQEKNEQELLELDKWAAAANWF

SEQ ID NO: 750 - protein, 36 aa, Artificial Sequence
  Core polypeptide
YTSLIHSLIEESQNQQEKNEQELLELDAAASLWNWF

SEQ ID NO: 751 - protein, 36 aa, Artificial Sequence
  Core polypeptide
YTSLIHSLIEESQNQQEKNEQELLAAAKWASLWNWF

SEQ ID NO: 752 - protein, 36 aa, Artificial Sequence
  Core polypeptide
YTSLIHSLIEESQNQQEKNEQAAAELDKWASLWNWF

SEQ ID NO: 753 - protein, 36 aa, Artificial Sequence
  Core polypeptide
YTSLIHSLIEESQNQQEKAAAELLELDKWASLWNWF

SEQ ID NO: 754 - protein, 36 aa, Artificial Sequence
  Core polypeptide
YTSLIHSLIEESQNQAAANEQELLELDKWASLWNWF

SEQ ID NO: 755 - protein, 36 aa, Artificial Sequence
  Core polypeptide
YTSLIHSLIEESAAAQEKNEQELLELDKWASLWNWF

SEQ ID NO: 756 - protein, 36 aa, Artificial Sequence
  Core polypeptide
YTSLIHSLIAAAQNQQEKNEQELLELDKWASLWNWF

SEQ ID NO: 757 - protein, 36 aa, Artificial Sequence
  Core polypeptide
YTSLIHAAAEESQNQQEKNEQELLELDKWASLWNWF

SEQ ID NO: 758 - protein, 36 aa, Artificial Sequence
  Core polypeptide
YTSAAASLIEESQNQQEKNEQELLELDKWASLWNWF

SEQ ID NO: 759 - protein, 35 aa, Artificial Sequence
  Core polypeptide
EIWNNMTWMEWDRENEKINQSLAFIRKSDELLHNV

SEQ ID NO: 760 - protein, 36 aa, Artificial Sequence
  Core polypeptide
YISEVNEEINQSLAFIRKADELLENVDKWASLWNWF

SEQ ID NO: 761 - protein, 35 aa, Artificial Sequence
  Core polypeptide
TSVITIELSNIKENKANGTDAKVKLIKQELDKYKN

SEQ ID NO: 762 - protein, 38 aa, Artificial Sequence
  Core polypeptide
YTSLIHSLIEESQNQQEKNEQELLELDKWASLWNWFMG

SEQ ID NO: 763 - protein, 21 aa, Artificial Sequence
  Core polypeptide
NEKINQSLAFIRKSDELLHNV

SEQ ID NO: 764 - protein, 35 aa, Artificial Sequence; identical to SEQ ID NO: 104
  Core polypeptide

SEQ ID NO: 765 - protein, 35 aa, Artificial Sequence; identical to SEQ ID NO: 106
  Core polypeptide

SEQ ID NO: 766 - protein, 35 aa, Artificial Sequence; identical to SEQ ID NO: 108
  Core polypeptide

SEQ ID NO: 767 - protein, 35 aa, Artificial Sequence; identical to SEQ ID NO: 112
  Core polypeptide

SEQ ID NO: 768 - protein, 35 aa, Artificial Sequence; identical to SEQ ID NO: 718
  Core polypeptide

SEQ ID NO: 769 - protein, 35 aa, Artificial Sequence; identical to SEQ ID NO: 692
  Core polypeptide

SEQ ID NO: 770 - protein, 35 aa, Artificial Sequence
  Core polypeptide
VYPSDEFDASISQVQEEIQQALAFIRKADELLEQV

SEQ ID NO: 771 - protein, 37 aa, Artificial Sequence
  Core polypeptide
NYTSLIHSLIEESQNQQEKNEQELLELDKWASLWNWF

SEQ ID NO: 772 - protein, 38 aa, Artificial Sequence
  Core polypeptide
NNYTSLIHSLIEESQNQQEKNEQELLELDKWASLWNWF

SEQ ID NO: 773 - protein, 39 aa, Artificial Sequence
  Core polypeptide
INNYTSLIHSLIEESQNQQEKNEQELLELDKWASLWNWF

SEQ ID NO: 774 - protein, 40 aa, Artificial Sequence
  Core polypeptide
EINNYTSLIHSLIEESQNQQEKNEQELLELDKWASLWNWF

SEQ ID NO: 775 - protein, 37 aa, Artificial Sequence
  Core polypeptide
YTSLIHSLIEESQNQQEKNEQELLELDKWASLWNWFN

SEQ ID NO: 776 - protein, 38 aa, Artificial Sequence
  Core polypeptide
YTSLIHSLIEESQNQQEKNEQELLELDKWASLWNWFNI

SEQ ID NO: 777 - protein, 39 aa, Artificial Sequence
  Core polypeptide
YTSLIHSLIEESQNQQEKNEQELLELDKWASLWNWFNIT

SEQ ID NO: 778 - protein, 40 aa, Artificial Sequence
  Core polypeptide
YTSLIHSLIEESQNQQEKNEQELLELDKWASLWNWFNITN

SEQ ID NO: 779 - protein, 43 aa, Artificial Sequence
  Core polypeptide
YDPLVFPSDEFDASISQVNEKINQSLAFIRKSDELLHNVNAGK

SEQ ID NO: 780 - protein, 38 aa, Artificial Sequence
  Core polypeptide
NYTSLIHSLIEESQNQQEKNEQELLELDKWASLWNWFN

SEQ ID NO: 781 - protein, 40 aa, Artificial Sequence
  Core polypeptide
NNYTSLIHSLIEESQNQQEKNEQELLELDKWASLWNWFNI

SEQ ID NO: 782 - protein, 49 aa, Artificial Sequence
  Core polypeptide
KCRAKFKQLLQHYREVAAAKSSENDRLRLLLKQMCPSLDVDSIIPRTPD

SEQ ID NO: 783 - protein, 47 aa, Artificial Sequence
  Core polypeptide
RAKFKQLLQHYREVAAAKSSENDRLRLLLKQMCPSLDVDSIIPRTPD

SEQ ID NO: 784 - protein, 35 aa, Artificial Sequence
  Core polypeptide
VYPSDEYDASISQVNEEINQALAYIAAADELLENV

SEQ ID NO: 785 - protein, 26 aa, Artificial Sequence
  Core polypeptide
YDASISQVNEEINQALAYIRKADELL

SEQ ID NO: 786 - protein, 40 aa, Artificial Sequence
  Core polypeptide
MNLEWMEWDREINNYTSLIHSLIEESQNQQEKNEQELLEL

SEQ ID NO: 787 - protein, 34 aa, Artificial Sequence
  Core polypeptide
KNGTYDYPKYEEESKLNRNEIKGVKLSSMGVYQI

SEQ ID NO: 788 - protein, 35 aa, Artificial Sequence
  Core polypeptide
VTEKIQMASDNINDLIQSGVNTRLLTIQSHVQNYI

SEQ ID NO: 789 - protein, 24 aa, Artificial Sequence
  Core polypeptide
QNQQEKNEQELLELDKWASLWNWF

SEQ ID NO: 790 - protein, 24 aa, Artificial Sequence
  Core polypeptide
QNQQEKNEQELLELDKWASLWNWF

SEQ ID NO: 791 - protein, 5 aa, Artificial Sequence
  Core polypeptide
LWNWF

SEQ ID NO: 792 - protein, 15 aa, Artificial Sequence
  Core polypeptide
ELLELDKWASLWNWF

SEQ ID NO: 793 - protein, 20 aa, Artificial Sequence
  Core polypeptide
EKNEQELLELDKWASLWNWF

SEQ ID NO: 794 - protein, 30 aa, Artificial Sequence
  Core polypeptide
SLIEESQNQQEKNEQELLELDKWASLWNWF

SEQ ID NO: 795 - protein, 35 aa, Artificial Sequence
  Core polypeptide
YTSLIHSLIEESQNQQEKNEQELLELDKWASLWNW

SEQ ID NO: 796 - protein, 34 aa, Artificial Sequence; identical to SEQ ID NO: 741
  Core polypeptide

SEQ ID NO: 797 - protein, 33 aa, Artificial Sequence; identical to SEQ ID NO: 742
  Core polypeptide

SEQ ID NO: 798 - protein, 32 aa, Artificial Sequence; identical to SEQ ID NO: 743
  Core polypeptide

SEQ ID NO: 799 - protein, 35 aa, Artificial Sequence; identical to SEQ ID NO: 638
  Core polypeptide

SEQ ID NO: 800 - protein, 34 aa, Artificial Sequence
  Core polypeptide
SLIHSLIEESQNQQEKNEQELLELDKWASLWNWF

SEQ ID NO: 801 - protein, 33 aa, Artificial Sequence; identical to SEQ ID NO: 61
  Core polypeptide

SEQ ID NO: 802 - protein, 32 aa, Artificial Sequence
  Core polypeptide
IHSLIEESQNQQEKNEQELLELDKWASLWNWF

SEQ ID NO: 803 - protein, 51 aa, Artificial Sequence
  Core polypeptide
AAVALLPAVLLALLAPSELEIKRYKNRVASRKCRAKFKQLLQHYREVAAAK

SEQ ID NO: 804 - protein, 51 aa, Artificial Sequence
  Core polypeptide
AAVALLPAVLLALLAPCRAKFKQLLQHYREVAAAKSSENDRLRLLLKQMCP

SEQ ID NO: 805 - protein, 36 aa, Artificial Sequence
  Core polypeptide
YTSLIHSLIEESQNQQEKNNNIERDWEMWTMNNWIQ

SEQ ID NO: 806 - protein, 35 aa, Artificial Sequence; identical to SEQ ID NO: 692
  Core polypeptide

SEQ ID NO: 807 - protein, 35 aa, Artificial Sequence
  Core polypeptide
LMQLARQLMQLARQMKQLADSLMQLARQVSRLESA

SEQ ID NO: 808 - protein, 34 aa, Artificial Sequence
  Core polypeptide
WMEWDREINNYTSLIHSLIEESQNQQEKNEQELL

SEQ ID NO: 809 - protein, 35 aa, Artificial Sequence
  Core polypeptide
MEWDREINNYTSLIHSLIEESQNQQEKNEQELLEL

SEQ ID NO: 810 - protein, 34 aa, Artificial Sequence
  Core polypeptide
EWDREINNYTSLIHSLIEESQNQQEKNEQELLEL

SEQ ID NO: 811 - protein, 34 aa, Artificial Sequence
  Core polypeptide
MEWDREINNYTSLIHSLIEESQNQQEKNEQELLE

SEQ ID NO: 812 - protein, 36 aa, Artificial Sequence
  Core polypeptide
WNEWDREINNYTSLIHSLIEESQNQQEKNEQELLEL

SEQ ID NO: 813 - protein, 36 aa, Artificial Sequence
  Core polypeptide
YLEYDREINNYTSLIHSLIEESQNQQEKNEQELLEL

SEQ ID NO: 814 - protein, 17 aa, Artificial Sequence
  Core polypeptide
IKQFINMWQEVGKAMYA

SEQ ID NO: 815 - protein, 8 aa, Artificial Sequence
  Core polypeptide
IRKSDELL

SEQ ID NO: 816 - protein, 8 aa, Artificial Sequence
  Core polypeptide
YDASISQV

SEQ ID NO: 817 - protein, 8 aa, Artificial Sequence
  Core polypeptide
NEKINQSL

SEQ ID NO: 818 - protein, 23 aa, Artificial Sequence
  Core polypeptide
SISQVNEEINQALAYIRKADELL

SEQ ID NO: 819 - protein, 20 aa, Artificial Sequence
  Core polypeptide
QVNEEINQALAYIRKADELL

SEQ ID NO: 820 - protein, 17 aa, Artificial Sequence
  Core polypeptide
EEINQALAYIRKADELL

SEQ ID NO: 821 - protein, 14 aa, Artificial Sequence
  Core polypeptide
NQALAYIRKADELL

SEQ ID NO: 822 - protein, 11 aa, Artificial Sequence
  Core polypeptide
LAYIRKADELL

SEQ ID NO: 823 - protein, 26 aa, Artificial Sequence
  Core polypeptide
FDASISQVNEKINQALAFIRKSDELL

SEQ ID NO: 824 - protein, 36 aa, Artificial Sequence; identical to SEQ ID NO: 812
  Core polypeptide

SEQ ID NO: 825 - protein, 45 aa, Artificial Sequence
  Core polypeptide
ASRKCRAKFKQLLQHYREVAAAKSSENDRLRLLLKQMCPSLDVDS

SEQ ID NO: 826 - protein, 4 aa, Artificial Sequence
  Core polypeptide
ZFFG

SEQ ID NO: 827 - protein, 36 aa, Artificial Sequence
  Core polypeptide
WLEWDREINNYTSLIHSLIEESQNQQEKNEQELLEL

SEQ ID NO: 828 - protein, 36 aa, Artificial Sequence
  Core polypeptide
YVKGEPIINFYDPLVFPSDEFDASISQVNEKINQSL

SEQ ID NO: 829 - protein, 35 aa, Artificial Sequence
  Core polypeptide
VYPSDEYDASISQVNEEINQSLAYIRKADELLHNV

SEQ ID NO: 830 - protein, 29 aa, Artificial Sequence
  Core polypeptide
YDASISQVNEEINQALAYIRKADELLENV

SEQ ID NO: 831 - protein, 27 aa, Artificial Sequence
  Core polypeptide
YDASISQVNEEINQALAYIRKADELLE

SEQ ID NO: 832 - protein, 35 aa, Artificial Sequence
  Core polypeptide
VYPSDEYDASISQVNEEINQALAYIRKAAELLHNV

SEQ ID NO: 833 - protein, 35 aa, Artificial Sequence
  Core polypeptide
VYPSDEYDASISQVNEEINQALAYIRKALELLHNV

SEQ ID NO: 834 - protein, 36 aa, Artificial Sequence; identical to SEQ ID NO: 15
  Core polypeptide

SEQ ID NO: 835 - protein, 35 aa, Artificial Sequence
  Core polypeptide
VYPSDEYDASISQVNEEINQLLAYIRKLDELLENV

SEQ ID NO: 836 - protein, 28 aa, Artificial Sequence
  Core polypeptide
DEYDASISQVNEKINQSLAFIRKSDELL

SEQ ID NO: 837 - protein, 35 aa, Artificial Sequence
  Core polypeptide
SNDQGSGYAADKESTQKAFDGITNKVNSVIEKTNT

SEQ ID NO: 838 - protein, 38 aa, Artificial Sequence
  Core polypeptide
ESTQKAFDGITNKVNSVIEKTNTQFEAVGKEFGNLEKR

SEQ ID NO: 839 - protein, 37 aa, Artificial Sequence
  Core polypeptide
DGITNKVNSVIEKTNTQFEAVGKEFGNLEKRLENLNK

SEQ ID NO: 840 - protein, 32 aa, Artificial Sequence
  Core polypeptide
DSNVKNLYDKVRSQLRDNVKELGNGAFEFYHK

SEQ ID NO: 841 - protein, 36 aa, Artificial Sequence
  Core polypeptide
RDNVKELGNGAFEFYHKADDEALNSVKNGTYDYPKY

SEQ ID NO: 842 - protein, 24 aa, Artificial Sequence
  Core polypeptide
EFYHKADDEALNSVKNGTYDYPKY

SEQ ID NO: 843 - protein, 36 aa, Artificial Sequence
  Core polypeptide
AAVALLPAVLLALLAPAADKESTQKAFDGITNKVNS

SEQ ID NO: 844 - protein, 36 aa, Artificial Sequence
  Core polypeptide
AAVALLPAVLLALLAPAADSNVKNLYDKVRSQLRDN

SEQ ID NO: 845 - protein, 18 aa, Artificial Sequence
  Core polypeptide
KESTQKAFDGITNKVNSV

SEQ ID NO: 846 - protein, 20 aa, Artificial Sequence
  Core polypeptide
IEKTNTQFEAVGKEFGNLER

SEQ ID NO: 847 - protein, 30 aa, Artificial Sequence
  Core polypeptide
RLENLNKRVEDGFLDVWTYNAELLVALENE

SEQ ID NO: 848 - protein, 17 aa, Artificial Sequence
  Core polypeptide
SNVKNLYDKVRSQLRDN

SEQ ID NO: 849 - protein, 33 aa, Artificial Sequence
  Core polypeptide
WMEWDREINNYTSLIHSLIEESQNQQEKNEQEL

SEQ ID NO: 850 - protein, 32 aa, Artificial Sequence
  Core polypeptide
WMEWDREINNYTSLIHSLIEESQNQQEKNEQE

SEQ ID NO: 851 - protein, 32 aa, Artificial Sequence
  Core polypeptide
MEWDREINNYTSLIHSLIEESQNQQEKNEQEL

SEQ ID NO: 852 - protein, 31 aa, Artificial Sequence
  Core polypeptide
MEWDREINNYTSLIHSLIEESQNQQEKNEQE

SEQ ID NO: 853 - protein, 33 aa, Artificial Sequence
  Core polypeptide
EWDREINNYTSLIHSLIEESQNQQEKNEQELLE

SEQ ID NO: 854 - protein, 32 aa, Artificial Sequence
  Core polypeptide
EWDREINNYTSLIHSLIEESQNQQEKNEQELL

SEQ ID NO: 855 - protein, 31 aa, Artificial Sequence
  Core polypeptide
EWDREINNYTSLIHSLIEESQNQQEKNEQEL

SEQ ID NO: 856 - protein, 36 aa, Artificial Sequence
  Core polypeptide
YTKFIYTLLEESQNQQEKNEQELLELDKWASLWNWF

SEQ ID NO: 857 - protein, 22 aa, Artificial Sequence
  Core polypeptide
YMKQLADSLMQLARQVSRLESA

SEQ ID NO: 858 - protein, 29 aa, Artificial Sequence
  Core polypeptide
YLMQLARQMKQLADSLMQLARQVSRLESA

SEQ ID NO: 859 - protein, 36 aa, Artificial Sequence
  Core polypeptide
YQEWERKVDFLEENITALLEEAQIQQEKNMYELQKL

SEQ ID NO: 860 - protein, 36 aa, Artificial Sequence
  Core polypeptide
WMAWAAAINNYTSLIHSLIEESQNQQEKNEQEEEEE

SEQ ID NO: 861 - protein, 36 aa, Artificial Sequence
  Core polypeptide
YASLIAALIEESQNQQEKNEQELLELAKWAALWAWF

SEQ ID NO: 862 - protein, 38 aa, Artificial Sequence
  Core polypeptide
EWDREINNYTSLIHSLIEESQNQQEKNEQEGGCDIMER

SEQ ID NO: 863 - protein, 35 aa, Artificial Sequence
  Core polypeptide
YDISIELNKAKSDLEESKEWIKKSNQKLDSIGNWH

SEQ ID NO: 864 - protein, 35 aa, Artificial Sequence; identical to SEQ ID NO: 548
  Core polypeptide

SEQ ID NO: 865 - protein, 6 aa, Artificial Sequence
  Core polypeptide
YTSLIH

SEQ ID NO: 866 - protein, 7 aa, Artificial Sequence
  Core polypeptide
HSLIEEH

SEQ ID NO: 867 - protein, 8 aa, Artificial Sequence
  Core polypeptide
SQNQQEKH

SEQ ID NO: 868 - protein, 9 aa, Artificial Sequence
  Core polypeptide
NEQELLELH

SEQ ID NO: 869 - protein, 7 aa, Artificial Sequence
  Core polypeptide
DKWASLH

SEQ ID NO: 870 - protein, 5 aa, Artificial Sequence
  Core polypeptide
WNWFH

SEQ ID NO: 871 - protein, 36 aa, Artificial Sequence
  Core polypeptide
AKTLERTWDTLNHLLFISSALYKLNLKSVAQITLSI

SEQ ID NO: 872 - protein, 24 aa, Artificial Sequence
  Core polypeptide
NITLQAKIKQFINMWQEVGKAMYA

SEQ ID NO: 873 - protein, 28 aa, Artificial Sequence
  Core polypeptide
LENERTLDFHDSNVKNLYDKVRLQLRDN

SEQ ID NO: 874 - protein, 35 aa, Artificial Sequence
  Core polypeptide
LENERTLDFHDSNVKNLYDKVRLQLRDNVKELGNG

SEQ ID NO: 875 - protein, 34 aa, Artificial Sequence
  Core polypeptide
TLDFHDSNVKNLYDKVRLQLRDNVKELGNGAFEF

SEQ ID NO: 876 - protein, 26 aa, Artificial Sequence
  Core polypeptide
FDASISQVNEKINQALAFIRKSDELL

SEQ ID NO: 877 - protein, 23 aa, Artificial Sequence
  Core polypeptide
SISQVNEEINQALAYIRKADELL

SEQ ID NO: 878 - protein, 23 aa, Artificial Sequence
  Core polypeptide
SISQVNEEINQSLAYIRKSDELL

SEQ ID NO: 879 - protein, 23 aa, Artificial Sequence
  Core polypeptide
SISQVNEEINQSLAYIRKSDELL

SEQ ID NO: 880 - protein, 35 aa, Artificial Sequence
  Core polypeptide
NSVALDPIDISIELNKAKSDLEESKEWIKKSNQKL

SEQ ID NO: 881 - protein, 35 aa, Artificial Sequence
  Core polypeptide
ALDPIDISIELNKAKSDLEESKEWIKKSNQKLDSI

SEQ ID NO: 882 - protein, 35 aa, Artificial Sequence; identical to SEQ ID NO: 880
  Core polypeptide

SEQ ID NO: 883 - protein, 35 aa, Artificial Sequence; identical to SEQ ID NO: 881
  Core polypeptide

SEQ ID NO: 884 - protein, 26 aa, Artificial Sequence
  Core polypeptide
YDASISQVNEEINQALAYIRKADELL

SEQ ID NO: 885 - protein, 26 aa, Artificial Sequence
  Core polypeptide
YDASISQVNEEINQSLAFIRKSDELL

SEQ ID NO: 886 - protein, 26 aa, Artificial Sequence
  Core polypeptide
YDASISQVNEEINQSLAFIRKSDELL

SEQ ID NO: 887 - protein, 33 aa, Artificial Sequence
  Core polypeptide
WLEWDREINNYTSLIHSLIEESQNQQEKNEQEL

SEQ ID NO: 888 - protein, 35 aa, Artificial Sequence; identical to SEQ ID NO: 202
  Core polypeptide

SEQ ID NO: 889 - protein, 35 aa, Artificial Sequence; identical to SEQ ID NO: 880
  Core polypeptide

SEQ ID NO: 890 - protein, 26 aa, Artificial Sequence
  Core polypeptide
YDASISQVNEEINQALAYIRKADELL

SEQ ID NO: 891 - protein, 28 aa, Artificial Sequence
  Core polypeptide
DEYDASISQVNEKINQSLAFIRKSDELL

SEQ ID NO: 892 - protein, 33 aa, Artificial Sequence
  Core polypeptide
WQEWEQKVRYLEANISQSLEQAQIQQEKNMYEL

SEQ ID NO: 893 - protein, 33 aa, Artificial Sequence
  Core polypeptide
WQEWEQKVRYLEANISQSLEQAQIQQEKNEYEL

SEQ ID NO: 894 - protein, 33 aa, Artificial Sequence
  Core polypeptide
WQEWEQKVRYLEANITALLEQAQIQQEKNEYEL

SEQ ID NO: 895 - protein, 33 aa, Artificial Sequence
  Core polypeptide
WQEWEQKVRYLEANITALLEQAQIQQEKNMYEL

SEQ ID NO: 896 - protein, 36 aa, Artificial Sequence
  Core polypeptide
WQEWEQKVRYLEANISQSLEQAQIQQEKNEYELQKL

SEQ ID NO: 897 - protein, 36 aa, Artificial Sequence
  Core polypeptide
WQEWEQKVRYLEANITALLEQAQIQQEKNEYELQKL

SEQ ID NO: 898 - protein, 36 aa, Artificial Sequence
  Core polypeptide
WQEWEQKVRYLEANITALLEQAQIQQEKNMYELQKL

SEQ ID NO: 899 - protein, 37 aa, Artificial Sequence
  Core polypeptide
EFGNLEKRLENLNKRVEDGFLDVWTYNAELLVALENE

SEQ ID NO: 900 - protein, 42 aa, Artificial Sequence
  Core polypeptide
EDGFLDVWTYNAELLVLMENERTLDFHDSNVKNLYDKVRMQL

SEQ ID NO: 901 - protein, 23 aa, Artificial Sequence
  Core polypeptide
SISQVNEKINQSLAFIRKSDELL

SEQ ID NO: 902 - protein, 23 aa, Artificial Sequence
  Core polypeptide
SISQVNEKINQSLAFIRKSDELL

SEQ ID NO: 903 - protein, 23 aa, Artificial Sequence
  Core polypeptide
SISQVNEKINQSLAYIRKSDELL

SEQ ID NO: 904 - protein, 38 aa, Artificial Sequence
  Core polypeptide
QQLLDVVKRQQEMLRLTVWGTKNLQARVTAIEKYLKDQ

SEQ ID NO: 905 - protein, 37 aa, Artificial Sequence
  Core polypeptide
YTSLIHSLIEESQNQQEKNEQELLELDKWASLWNWFC

SEQ ID NO: 906 - protein, 26 aa, Artificial Sequence
  Core polypeptide
FDASISQVNEKINQSLAYIRKSDELL

SEQ ID NO: 907 - protein, 30 aa, Artificial Sequence
  Core polypeptide
YTSLIHSLIEESQNQQEKNEQELLELDKWA

SEQ ID NO: 908 - protein, 28 aa, Artificial Sequence
  Core polypeptide
DEFDASISQVNEKINQSLAFIRKSDELL

SEQ ID NO: 909 - protein, 28 aa, Artificial Sequence
  Core polypeptide
DEFDESISQVNEKINQSLAFIRKSDELL

SEQ ID NO: 910 - protein, 28 aa, Artificial Sequence
  Core polypeptide
DEFDESISQVNEKIEQSLAFIRKSDELL

SEQ ID NO: 911 - protein, 28 aa, Artificial Sequence
  Core polypeptide
DEFDESISQVNEKIEESLAFIRKSDELL

SEQ ID NO: 912 - protein, 28 aa, Artificial Sequence
  Core polypeptide
DEFDESISQVNEKIEESLQFIRKSDELL

SEQ ID NO: 913 - protein, 33 aa, Artificial Sequence
  Core polypeptide
GGGGGDEFDASISQVNEKINQSLAFIRKSDELL

SEQ ID NO: 914 - protein, 28 aa, Artificial Sequence
  Core polypeptide
DEFDASISQVNEKINQSLAFIRKSDELL

SEQ ID NO: 915 - protein, 28 aa, Artificial Sequence
  Core polypeptide
DEFDASISQVNEKINQSLAFIRKSDELL

SEQ ID NO: 916 - protein, 35 aa, Artificial Sequence; identical to SEQ ID NO: 198
  Core polypeptide

SEQ ID NO: 917 - protein, 35 aa, Artificial Sequence
  Core polypeptide
YDASISQVNEKINQALAYIRKADELLHNVNAGKST

SEQ ID NO: 918 - protein, 35 aa, Artificial Sequence
  Core polypeptide
VYPSDEYDASISQVNEKINQALAYIRKADELLHNV

SEQ ID NO: 919 - protein, 8 aa, Artificial Sequence
  Core polypeptide
WGWGYGYG

SEQ ID NO: 920 - protein, 9 aa, Artificial Sequence
  Core polypeptide
YGWGWGWGF

SEQ ID NO: 921 - protein, 36 aa, Artificial Sequence
  Core polypeptide
WQEWEQKVRYLEANITALQEQAQIQAEKAEYELQKL

SEQ ID NO: 922 - protein, 36 aa, Artificial Sequence
  Core polypeptide
WQEWEQKVRYLEAEITALQEEAQIQAEKAEYELQKL

SEQ ID NO: 923 - protein, 31 aa, Artificial Sequence; identical to SEQ ID NO: 744
  Core polypeptide

SEQ ID NO: 924 - protein, 35 aa, Artificial Sequence
  Core polypeptide
VWPSDEFDASISQVNEKINQSLAFIRKSDELLHNV

SEQ ID NO: 925 - protein, 35 aa, Artificial Sequence
  Core polypeptide
SKNISEQIDQIKKDEQKEGTGWGLGGKWWTSDWGV

SEQ ID NO: 926 - protein, 35 aa, Artificial Sequence
  Core polypeptide
LSKNISEQIDQIKKDEQKEGTGWGLGGKWWTSDWG

SEQ ID NO: 927 - protein, 35 aa, Artificial Sequence
  Core polypeptide
DLSKNISEQIDQIKKDEQKEGTGWGLGGKWWTSDW

SEQ ID NO: 928 - protein, 35 aa, Artificial Sequence
  Core polypeptide
EDLSKNISEQIDQIKKDEQKEGTGWGLGGKWWTSD

SEQ ID NO: 929 - protein, 35 aa, Artificial Sequence
  Core polypeptide
IEDLSKNISEQIDQIKKDEQKEGTGWGLGGKWWTS

SEQ ID NO: 930 - protein, 35 aa, Artificial Sequence
  Core polypeptide
GIEDLSKNISEQIDQIKKDEQKEGTGWGLGGKWWT

SEQ ID NO: 931 - protein, 35 aa, Artificial Sequence
  Core polypeptide
IGIEDLSKNISEQIDQIKKDEQKEGTGWGLGGKWW

SEQ ID NO: 932 - protein, 34 aa, Artificial Sequence
  Core polypeptide
PSDEFDASISQVNEKINQSLAFIRKSDELLHNVN

SEQ ID NO: 933 - protein, 35 aa, Artificial Sequence
  Core polypeptide
VYPSDEYDASISQVNEKINQALAYIRKADELLENV

SEQ ID NO: 934 - protein, 35 aa, Artificial Sequence
  Core polypeptide
VYPSDEFDASISQVNEKINQALAFIRKADELLENV

SEQ ID NO: 935 - protein, 35 aa, Artificial Sequence
  Core polypeptide
VYPSDEYDASISQVNEKINQALAYIREADELLENV

SEQ ID NO: 936 - protein, 26 aa, Artificial Sequence
  Core polypeptide
YDASISQVNEKINQSLAFIRESDELL

SEQ ID NO: 937 - protein, 35 aa, Artificial Sequence
  Core polypeptide
AIGIEDLSKNISEQIDQIKKDEQKEGTGWGLGGKW

SEQ ID NO: 938 - protein, 35 aa, Artificial Sequence
  Core polypeptide
AAIGIEDLSKNISEQIDQIKKDEQKEGTGWGLGGK

SEQ ID NO: 939 - protein, 35 aa, Artificial Sequence
  Core polypeptide
DAAIGIEDLSKNISEQIDQIKKDEQKEGTGWGLGG

SEQ ID NO: 940 - protein, 35 aa, Artificial Sequence
  Core polypeptide
PDAAIGIEDLSKNISEQIDQIKKDEQKEGTGWGLG

SEQ ID NO: 941 - protein, 35 aa, Artificial Sequence
  Core polypeptide
NITDKIDQIIHDFVDKTLPDQGDNDNWWTGWRQWI

SEQ ID NO: 942 - protein, 35 aa, Artificial Sequence
  Core polypeptide
KNITDKIDQIIHDFVDKTLPDQGDNDNWWTGWRQW

SEQ ID NO: 943 - protein, 35 aa, Artificial Sequence
  Core polypeptide
TKNITDKIDQIIHDFVDKTLPDQGDNDNWWTGWRQ

SEQ ID NO: 944 - protein, 35 aa, Artificial Sequence
  Core polypeptide
WTKNITDKIDQIIHDFVDKTLPDQGDNDNWWTGWR

SEQ ID NO: 945 - protein, 35 aa, Artificial Sequence
  Core polypeptide
DWTKNITDKIDQIIHDFVDKTLPDQGDNDNWWTGW

SEQ ID NO: 946 - protein, 35 aa, Artificial Sequence
  Core polypeptide
HDWTKNITDKIDQIIHDFVDKTLPDQGDNDNWWTG

SEQ ID NO: 947 - protein, 35 aa, Artificial Sequence
  Core polypeptide
PHDWTKNITDKIDQIIHDFVDKTLPDQGDNDNWWT

SEQ ID NO: 948 - protein, 35 aa, Artificial Sequence
  Core polypeptide
EPHDWTKNITDKIDQIIHDFVDKTLPDQGDNDNWW

SEQ ID NO: 949 - protein, 35 aa, Artificial Sequence
  Core polypeptide
IEPHDWTKNITDKIDQIIHDFVDKTLPDQGDNDNW

SEQ ID NO: 950 - protein, 35 aa, Artificial Sequence
  Core polypeptide
AIEPHDWTKNITDKIDQIIHDFVDKTLPDQGDNDN

SEQ ID NO: 951 - protein, 35 aa, Artificial Sequence
  Core polypeptide
AAIEPHDWTKNITDKIDQIIHDFVDKTLPDQGDND

SEQ ID NO: 952 - protein, 35 aa, Artificial Sequence
  Core polypeptide
DAAIEPHDWTKNITDKIDQIIHDFVDKTLPDQGDN

SEQ ID NO: 953 - protein, 35 aa, Artificial Sequence
  Core polypeptide
LSPTVWLSVIWMMWYWGPSLYSILSPFLPLLPIFF

SEQ ID NO: 954 - protein, 45 aa, Artificial Sequence
  Core polypeptide
HNHTTWMEWDREINNYTSLIHSLIEESQNQQEKNEQELLELDKWH

SEQ ID NO: 955 - protein, 53 aa, Artificial Sequence
  Core polypeptide
HQARQLLSGIVQQQNNLLRAIEAQQHLLQLTVWGIKQLQARILAVERYLKDQH

SEQ ID NO: 956 - protein, 35 aa, Artificial Sequence
  Core polypeptide
VYPSDEFDASISQVNEKINQSLAFIREADELLENV

SEQ ID NO: 957 - protein, 35 aa, Artificial Sequence
  Core polypeptide
VFPSDEFDASISQVNEKINQSLAYIREADELLENV

SEQ ID NO: 958 - protein, 28 aa, Artificial Sequence
  Core polypeptide
DEFDASISQVNEKINQSLAYIREADELL

SEQ ID NO: 959 - protein, 50 aa, Artificial Sequence
  Core polypeptide
NEQELLELDKWASLWNWFGGGGDEFDASISQVNEKINQSLAFIRKSDELL

SEQ ID NO: 960 - protein, 45 aa, Artificial Sequence
  Core polypeptide
LELDKWASLWNWFGGGGDEFDASISQVNEKINQSLAFIRKSDELL

SEQ ID NO: 961 - protein, 36 aa, Artificial Sequence
  Core polypeptide
EGEGEGEGDEFDASISQVNEKINQSLAFIRKSDELL

SEQ ID NO: 962 - protein, 43 aa, Artificial Sequence
  Core polypeptide
ASRKCRAKFKQLLQHYREVAAAKSSENDRLRLLLKQMCPSLDV

SEQ ID NO: 963 - protein, 29 aa, Artificial Sequence
  Core polypeptide
GDEEDASISQVNEKINQSLAFIRKSDELL

SEQ ID NO: 964 - protein, 29 aa, Artificial Sequence
  Core polypeptide
GDEEDASESQVNEKINQSLAFIRKSDELL

SEQ ID NO: 965 - protein, 29 aa, Artificial Sequence
  Core polypeptide
GDEEDASESQQNEKINQSLAFIRKSDELL

SEQ ID NO: 966 - protein, 29 aa, Artificial Sequence
  Core polypeptide
GDEEDASESQQNEKQNQSLAFIRKSDELL

SEQ ID NO: 967 - protein, 29 aa, Artificial Sequence
  Core polypeptide
GDEEDASESQQNEKQNQSEAFIRKSDELL

SEQ ID NO: 968 - protein, 30 aa, Artificial Sequence
  Core polypeptide
WGDEFDESISQVNEKIEESLAFIRKSDELL

SEQ ID NO: 969 - protein, 40 aa, Artificial Sequence
  Core polypeptide
YTSLGGDEFDESISQVNEKIEESLAFIRKSDELLGGWNWF

SEQ ID NO: 970 - protein, 48 aa, Artificial Sequence
  Core polypeptide
YTSLIHSLGGDEFDESISQVNEKIEESLAFIRKSDELLGGWASLWNWF

SEQ ID NO: 971 - protein, 29 aa, Artificial Sequence
  Core polypeptide
GDEFDESISQVNEKIEESLAFIRKSDELL

SEQ ID NO: 972 - protein, 29 aa, Artificial Sequence
  Core polypeptide
GDEEDESISQVNEKIEESLAFIRKSDELL

SEQ ID NO: 973 - protein, 29 aa, Artificial Sequence
  Core polypeptide
GDEEDESISQVQEKIEESLAFIRKSDELL

SEQ ID NO: 974 - protein, 29 aa, Artificial Sequence
  Core polypeptide
GDEEDESISQVQEKIEESLLFIRKSDELL

SEQ ID NO: 975 - protein, 29 aa, Artificial Sequence
  Core polypeptide
GDEYDESISQVNEKIEESLAFIRKSDELL

SEQ ID NO: 976 - protein, 29 aa, Artificial Sequence
  Core polypeptide
GDEYDESISQVNEKIEESLAFIRKSDELL

SEQ ID NO: 977 - protein, 36 aa, Artificial Sequence
  Core polypeptide
YTSLIHSLIDEQEKIEELAFIRKSDELLELDKWNWF

SEQ ID NO: 978 - protein, 35 aa, Artificial Sequence; identical to SEQ ID NO: 692
  Core polypeptide

SEQ ID NO: 979 - protein, 38 aa, Artificial Sequence
  Core polypeptide
NNLLRAIEAQQHLLQLTVWGSKQLQARILAVERYLKDQ

SEQ ID NO: 980 - protein, 38 aa, Artificial Sequence
  Core polypeptide
GGGVYPSDEYDASISQVNEEINQALAYIRKADELLENV

SEQ ID NO: 981 - protein, 38 aa, Artificial Sequence
  Core polypeptide
NNLLRAIEAQQHLLQLTVWGEKQLQARILAVERYLKDQ

SEQ ID NO: 982 - protein, 28 aa, Artificial Sequence
  Core polypeptide
PTRVNYILIIGVLVLAEVTGVRADVHLL

SEQ ID NO: 983 - protein, 35 aa, Artificial Sequence
  Core polypeptide
PTRVNYILIIGVLVLAEVTGVRADVHLLEQPGNLW

SEQ ID NO: 984 - protein, 36 aa, Artificial Sequence
  Core polypeptide
PEKTPLLPTRVNYILIIGVLVLABEVTGVRADVHLL

SEQ ID NO: 985 - protein, 38 aa, Artificial Sequence; identical to SEQ ID NO: 980
  Core polypeptide

SEQ ID NO: 986 - protein, 38 aa, Artificial Sequence
  Core polypeptide
YTSLIHSLGGDEFDESISQVNEKIEESLAFIRKSDELL

SEQ ID NO: 987 - protein, 34 aa, Artificial Sequence
  Core polypeptide
YTSLGGDEFDESISQVNEKIEESLAFIRKSDELL

SEQ ID NO: 988 - protein, 38 aa, Artificial Sequence
  Core polypeptide
DEFDESISQVNEKIEESLAFIRKSDELLGGWASLWNWF

SEQ ID NO: 989 - protein, 34 aa, Artificial Sequence
  Core polypeptide
DEFDESISQVNEKIEESLAFIRKSDELLGGWNWF

SEQ ID NO: 990 - protein, 35 aa, Artificial Sequence
  Core polypeptide
YTSLIHSLIEESQNQQEKNEQELLELDKASLWNWF

SEQ ID NO: 991 - protein, 34 aa, Artificial Sequence
  Core polypeptide
YTSLIHSLIEESQNQQEKNEQELLELDKSLWNWF

SEQ ID NO: 992 - protein, 33 aa, Artificial Sequence
  Core polypeptide
YTSLIHSLIEESQNQQEKNEQELLELDKLWNWF

SEQ ID NO: 993 - protein, 32 aa, Artificial Sequence
  Core polypeptide
YTSLIHSLIEESQNQQEKNEQELLELDKWNWF

SEQ ID NO: 994 - protein, 47 aa, Artificial Sequence
  Core polypeptide
MTWMEWDREINNYTSLIHSLIEESQNQQEKNEQELLELDKASLWNWF

SEQ ID NO: 995 - protein, 46 aa, Artificial Sequence
  Core polypeptide
MTWMEWDREINNYTSLIHSLIEESQNQQEKNEQELLELDKSLWNWF

SEQ ID NO: 996 - protein, 45 aa, Artificial Sequence
  Core polypeptide
MTWMEWDREINNYTSLIHSLIEESQNQQEKNEQELLELDKLWNWF

SEQ ID NO: 997 - protein, 44 aa, Artificial Sequence
  Core polypeptide
MTWMEWDREINNYTSLIHSLIEESQNQQEKNEQELLELDKWNWF

SEQ ID NO: 998 - protein, 46 aa, Artificial Sequence
  Core polypeptide
MTWMEWDREINNYTSLIHSLIEESQNQQEKNEQELLELDKWASLWN

SEQ ID NO: 999 - protein, 44 aa, Artificial Sequence
  Core polypeptide
MTWMEWDREINNYTSLIHSLIEESQNQQEKNEQELLELDKWASL

SEQ ID NO: 1000 - protein, 8 aa, Artificial Sequence
  Core polypeptide
HWSYLRPG

SEQ ID NO: 1001 - protein, 36 aa, Artificial Sequence
  Core polypeptide
WNWFDEFDESISQVNEKIEESLAFIRKSDELLWNWF

SEQ ID NO: 1002 - protein, 36 aa, Artificial Sequence
  Core polypeptide
YTSLIHSLIEESQNQQEKNEQELLELDKYASLYNYF

SEQ ID NO: 1003 - protein, 36 aa, Artificial Sequence
  Core polypeptide
YTSLIHSLIEESQNQQEKNEQELLELDKYAYLYNYF

SEQ ID NO: 1004 - protein, 29 aa, Artificial Sequence
  Core polypeptide
DEFDESISQVNEKIEESLAFIRKSDELLW

SEQ ID NO: 1005 - protein, 31 aa, Artificial Sequence
  Core polypeptide
GDEFDESISQVNEKIEESLAFIRKSDELLGW

SEQ ID NO: 1006 - protein, 29 aa, Artificial Sequence
  Core polypeptide
GDEFDESISQVNEKIEESLAFIRESDELL

SEQ ID NO: 1007 - protein, 29 aa, Artificial Sequence
  Core polypeptide
GDEFDESISQVNEKIEESLAFIEESDELL

SEQ ID NO: 1008 - protein, 36 aa, Artificial Sequence
  Core polypeptide
WQEWEQKVNYLEANITALLEQAQIQQEKNEYELQKL

SEQ ID NO: 1009 - protein, 36 aa, Artificial Sequence
  Core polypeptide
WQEWEQKVDYLEANITALLEQAQIQQEKNEYELQKL

SEQ ID NO: 1010 - protein, 36 aa, Artificial Sequence
  Core polypeptide
WQEWEQKVRWLEANITALLEQAQIQQEKNEYELQKL

SEQ ID NO: 1011 - protein, 36 aa, Artificial Sequence
  Core polypeptide
WQEWEKQVRYLEANITALLEQAQIQQEKNEYELQKL

SEQ ID NO: 1012 - protein, 36 aa, Artificial Sequence
  Core polypeptide
WQEWEHQVRYLEANITALLEQAQIQQEKNEYELQKL

SEQ ID NO: 1013 - protein, 36 aa, Artificial Sequence
  Core polypeptide
WQEWEHKVRYLEANITALLEQAQIQQEKNEYELQKL

SEQ ID NO: 1014 - protein, 36 aa, Artificial Sequence
  Core polypeptide
WQEWDREVRYLEANITALLEQAQIQQEKNEYELQKL

SEQ ID NO: 1015 - protein, 36 aa, Artificial Sequence
  Core polypeptide
WQEWEREVRYLEANITALLEQAQIQQEKNEYELQKL

SEQ ID NO: 1016 - protein, 36 aa, Artificial Sequence
  Core polypeptide
WQEWERQVRYLEANITALLEQAQIQQEKNEYELQKL

SEQ ID NO: 1017 - protein, 36 aa, Artificial Sequence
  Core polypeptide
WQEWEQKVKYLEANITALLEQAQIQQEKNEYELQKL

SEQ ID NO: 1018 - protein, 36 aa, Artificial Sequence
  Core polypeptide
WQEWEQKVRFLEANITALLEQAQIQQEKNEYELQKL

SEQ ID NO: 1019 - protein, 35 aa, Artificial Sequence
  Core polypeptide
VNPSDEYDASISQVNEEINQALAYIRKADELLENV

SEQ ID NO: 1020 - protein, 35 aa, Artificial Sequence
  Core polypeptide
VNPSDENDASISQVNEEINQALAYIRKADELLENV

SEQ ID NO: 1021 - protein, 35 aa, Artificial Sequence
  Core polypeptide
VNPSDEYDASISQVNEEINQALANIRKADELLENV

SEQ ID NO: 1022 - protein, 36 aa, Artificial Sequence
  Core polypeptide
VYPSDEFDASISQVNEKINQSLAFIREADELLFNFF

SEQ ID NO: 1023 - protein, 36 aa, Artificial Sequence
  Core polypeptide
VYPSDEYDASISQVNEEINQALAYIRKADELLFNFF

SEQ ID NO: 1024 - protein, 36 aa, Artificial Sequence
  Core polypeptide
YTSLITALLEQAQIQQEKNEYELQKLDKWASLWNWF

SEQ ID NO: 1025 - protein, 36 aa, Artificial Sequence
  Core polypeptide
YTSLITALLEQAQIQQEKNEYELQKLDKWASLWEWF

SEQ ID NO: 1026 - protein, 36 aa, Artificial Sequence
  Core polypeptide
YTSLITALLEQAQIQQEKNEYELQKLDEWASLWEWF

SEQ ID NO: 1027 - protein, 36 aa, Artificial Sequence
  Core polypeptide
YTSLITALLEQAQIQQEKNEYELQELDEWASLWEWF

SEQ ID NO: 1028 - protein, 36 aa, Artificial Sequence
  Core polypeptide
YTSLITALLEEAQIQQEKNEYELQELDEWASLWEWF

SEQ ID NO: 1029 - protein, 28 aa, Artificial Sequence
  Core polypeptide
AAATALLEQAQIQQEKNEYELQKLAAAW

SEQ ID NO: 1030 - protein, 36 aa, Artificial Sequence
  Core polypeptide
WAAWEQKVRYLEANITALLEQAQIQQEKNEYELQKL

SEQ ID NO: 1031 - protein, 36 aa, Artificial Sequence
  Core polypeptide
WQEAAQKVRYLEANITALLEQAQIQQEKNEYELQKL

SEQ ID NO: 1032 - protein, 36 aa, Artificial Sequence
  Core polypeptide
WQEWAAKVRYLEANITALLEQAQIQQEKNEYELQKL

SEQ ID NO: 1033 - protein, 36 aa, Artificial Sequence
  Core polypeptide
WQEWEQKAAYLEANITALLEQAQIQQEKNEYELQKL

SEQ ID NO: 1034 - protein, 36 aa, Artificial Sequence
  Core polypeptide
WQEWEQKVAALEANITALLEQAQIQQEKNEYELQKL

SEQ ID NO: 1035 - protein, 29 aa, Artificial Sequence
  Core polypeptide
GDEFDASISQVNEKINQSLAFIRKSDELT

SEQ ID NO: 1036 - protein, 29 aa, Artificial Sequence
  Core polypeptide
GDEFDASISQVNEKINQSLAFTRKSDELT

SEQ ID NO: 1037 - protein, 29 aa, Artificial Sequence
  Core polypeptide
GDEFDASISQVNEKTNQSLAFTRKSDELT

SEQ ID NO: 1038 - protein, 29 aa, Artificial Sequence
  Core polypeptide
GDEFDASISQTNEKTNQSLAFTRKSDELT

SEQ ID NO: 1039 - protein, 29 aa, Artificial Sequence
  Core polypeptide
GDEFDASTSQTNEKTNQSLAFTRKSDELT

SEQ ID NO: 1040 - protein, 29 aa, Artificial Sequence
  Core polypeptide
GDEYDASTSQTNEKTNQSLAFTRKSDELT

SEQ ID NO: 1041 - protein, 29 aa, Artificial Sequence
  Core polypeptide
GDEFDEEISQVNEKIEESLAFIRKSDELL

SEQ ID NO: 1042 - protein, 29 aa, Artificial Sequence
  Core polypeptide
GDEFDASISQVNEKINQSLAFIRKSDELA

SEQ ID NO: 1043 - protein, 29 aa, Artificial Sequence
  Core polypeptide
GDEFDASASQANEKANQSLAFARKSDELA

SEQ ID NO: 1044 - protein, 29 aa, Artificial Sequence
  Core polypeptide
GDEFDESISQVNEKIEESLAFTRKSDELL

SEQ ID NO: 1045 - protein, 29 aa, Artificial Sequence
  Core polypeptide
GDEFDESISQVNEKTEESLAFIRKSDELL

SEQ ID NO: 1046 - protein, 29 aa, Artificial Sequence
  Core polypeptide
GDEFDESISQTNEKIEESLAFIRKSDELL

SEQ ID NO: 1047 - protein, 29 aa, Artificial Sequence
  Core polypeptide
GDEFDESTSQVNEKIEESLAFIRKSDELL

SEQ ID NO: 1048 - protein, 36 aa, Artificial Sequence
  Core polypeptide
WNWFDEFDESTSQVNEKIEESLAFIRKSDELLWNWF

SEQ ID NO: 1049 - protein, 36 aa, Artificial Sequence
  Core polypeptide
WNWFDEFDESTSQTNEKIEESLAFIRKSDELLWNWF

SEQ ID NO: 1050 - protein, 36 aa, Artificial Sequence
  Core polypeptide
WNWFDEFDESTSQTNEKTEESLAFIRKSDELLWNWF

SEQ ID NO: 1051 - protein, 36 aa, Artificial Sequence
  Core polypeptide
YTNLIYTLLEESQNQQEKNEQELLELDKWASLWSWF

SEQ ID NO: 1052 - protein, 46 aa, Artificial Sequence
  Core polypeptide
WQEWEQKVRYLEANITALLEQAQIQQEKNEYELQKLDKWASLWNWF

SEQ ID NO: 1053 - protein, 50 aa, Artificial Sequence
  Core polypeptide
NNMTWQEWEQKVRYLEANITALLEQAQIQQEKNEYELQKLDKWASLWNWF

SEQ ID NO: 1054 - protein, 16 aa, Artificial Sequence
  Core polypeptide
WNWFIEESDELLWNWF

SEQ ID NO: 1055 - protein, 11 aa, Artificial Sequence
  Core polypeptide
GFIEESDELLW

SEQ ID NO: 1056 - protein, 11 aa, Artificial Sequence
  Core polypeptide
WFIEESDELLW

SEQ ID NO: 1057 - protein, 17 aa, Artificial Sequence
  Core polypeptide
GFNFFIEESDELLFNFF

SEQ ID NO: 1058 - protein, 7 aa, Artificial Sequence
  Core polypeptide
GESDELW

SEQ ID NO: 1059 - protein, 39 aa, Artificial Sequence
  Core polypeptide
WNWFGDEFDESISQVQEEIEESLAFIEESDELLGGWNWF

SEQ ID NO: 1060 - protein, 48 aa, Artificial Sequence
  Core polypeptide
YTSLIHSLGGDEFDESISQVNEEIEESLAFIEESDELLGGWASLWNWF

SEQ ID NO: 1061 - protein, 29 aa, Artificial Sequence
  Core polypeptide
GDEFDESISQVQEEIEESLAFIEESDELL

SEQ ID NO: 1062 - protein, 53 aa, Artificial Sequence
  Core polypeptide
HQARQLLSSIMQQQNNLLRAIEAQQHLLQLTVWGIKQLQARILAVERYLKDQH

SEQ ID NO: 1063 - protein, 25 aa, Artificial Sequence
  Core polypeptide
CPKYVKQNTLKLATGMRNVPEKQTR

SEQ ID NO: 1064 - protein, 30 aa, Artificial Sequence
  Core polypeptide
GLFGAIAGFIENGWEGMIDGWYGFRHQNSC

SEQ ID NO: 1065 - protein, 7 aa, Artificial Sequence
  Core polypeptide
LNFLGGT

SEQ ID NO: 1066 - protein, 14 aa, Artificial Sequence
  Core polypeptide
LDSWWTSLNFLGGT

SEQ ID NO: 1067 - protein, 21 aa, Artificial Sequence
  Core polypeptide
ILTIPQSLDSWWTSLNFLGGT

SEQ ID NO: 1068 - protein, 28 aa, Artificial Sequence
  Core polypeptide
GFFLLTRILTIPQSLDSWWTSLNFLGGT

SEQ ID NO: 1069 - protein, 39 aa, Artificial Sequence
  Core polypeptide
WQEWEQKITALLEQAQIQQEKNEYELQKLDKWASLWNWF

SEQ ID NO: 1070 - protein, 36 aa, Artificial Sequence
  Core polypeptide
WNWFITALLEQAQIQQEKNEYELQKLDKWASLWNWF

SEQ ID NO: 1071 - protein, 39 aa, Artificial Sequence
  Core polypeptide
WQEWEQKITALLEQAQIQQEKNEYELQKLDKWASLWEWF

SEQ ID NO: 1072 - protein, 36 aa, Artificial Sequence
  Core polypeptide
WQEWEQKVRYLEANITALLEQAQIQQEKIEYELQKL

SEQ ID NO: 1073 - protein, 36 aa, Artificial Sequence
  Core polypeptide
WQEWEQKVRYLEAQITALLEQAQIQQEKIEYELQKL

SEQ ID NO: 1074 - protein, 35 aa, Artificial Sequence
  Core polypeptide
KENKANGTDAKVKLIKQELDKYKNAVTELQLLMQS

SEQ ID NO: 1075 - protein, 35 aa, Artificial Sequence
  Core polypeptide
NIKENKANGTDAKVKLIKQELDKYKNAVTELQLLM

SEQ ID NO: 1076 - protein, 36 aa, Artificial Sequence; identical to SEQ ID NO: 15
  Core polypeptide

SEQ ID NO: 1077 - protein, 37 aa, Artificial Sequence
  Core polypeptide
GWNWFDEFDESISQVQEEIEESLAFIEESDELLWNWF

SEQ ID NO: 1078 - protein, 38 aa, Artificial Sequence
  Core polypeptide
WNWFGDEFDESISQVNEKIEESLAFIEESDELLGWNWF

SEQ ID NO: 1079 - protein, 38 aa, Artificial Sequence
  Core polypeptide
WNWFGDEFDESISQVNEKIEESLAFIRKSDELLGWNWF

SEQ ID NO: 1080 - protein, 36 aa, Artificial Sequence; identical to SEQ ID NO: 1001
  Core polypeptide

SEQ ID NO: 1081 - protein, 36 aa, Artificial Sequence
  Core polypeptide
WNWFDEFDESISQVNEKIEESLAFIEESDELLWNWF

SEQ ID NO: 1082 - protein, 21 aa, Artificial Sequence
  Core polypeptide
EESQNQQEKNEQELLELDKWA

SEQ ID NO: 1083 - protein, 21 aa, Artificial Sequence
  Core polypeptide
EESQNQQEKNEQELLELDKWA

SEQ ID NO: 1084 - protein, 36 aa, Artificial Sequence
  Core polypeptide
CGTTDRSGAPTYSWGANDTDVFVLNNTRPPLGNWFG

SEQ ID NO: 1085 - protein, 28 aa, Artificial Sequence
  Core polypeptide
GVEHRLEANWTRGERADLEDRDRSELSP

SEQ ID NO: 1086 - protein, 27 aa, Artificial Sequence
  Core polypeptide
CVREGNASRAWVAVTPTVATRDGKLPT

SEQ ID NO: 1087 - protein, 20 aa, Artificial Sequence
  Core polypeptide
CFSPRHHWTTQDANASIYPG

SEQ ID NO: 1088 - protein, 33 aa, Artificial Sequence
  Core polypeptide
LQHYREVAAAKSSENDRLRLLLKQMCPSLDVDS

SEQ ID NO: 1089 - protein, 46 aa, Artificial Sequence
  Core polypeptide
WQEWDREISNYTSLITALLEQAQIQQEKNEYELQKLDEWASLWEWF

SEQ ID NO: 1090 - protein, 48 aa, Artificial Sequence
  Core polypeptide
CWQEWDREISNYTSLITALLEQAQIQQEKNEYELQKLDEWASLWEWFC

SEQ ID NO: 1091 - protein, 42 aa, Artificial Sequence
  Core polypeptide
WQEWDREISNYTSLITALLEQAQIQQEKNEYELQKLDEWEWF

SEQ ID NO: 1092 - protein, 44 aa, Artificial Sequence
  Core polypeptide
CWQEWDREISNYTSLITALLEQAQIQQEKNEYELQKLDEWEWFC

SEQ ID NO: 1093 - protein, 26 aa, Artificial Sequence
  Core polypeptide
GQNSQSPTSNHSPTSAPPTAPGYRWA

SEQ ID NO: 1094 - protein, 27 aa, Artificial Sequence
  Core polypeptide
PGSSTTSTGPARTALTTAQGTSLYPSA

SEQ ID NO: 1095 - protein, 39 aa, Artificial Sequence
  Core polypeptide
PGSSTTSTGPARTALTTAQGTSLYPSAAATKPSDGNATA

SEQ ID NO: 1096 - protein, 16 aa, Artificial Sequence
  Core polypeptide
QKQEPIDKELYPLTSL

SEQ ID NO: 1097 - protein, 39 aa, Artificial Sequence
  Core polypeptide
WQEWDREITALLEQAQIQQEKNEYELQKLDKWASLWNWF

SEQ ID NO: 1098 - protein, 39 aa, Artificial Sequence
  Core polypeptide
WQEWDREITALLEQAQIQQEKNEYELQKLDEWASLWEWF

SEQ ID NO: 1099 - protein, 35 aa, Artificial Sequence
  Core polypeptide
WQEWDREITALLEQAQIQQEKNEYELQKLDEWEWF

SEQ ID NO: 1100 - protein, 35 aa, Artificial Sequence
  Core polypeptide
WQEWEREITALLEQAQIQQEKNEYELQKLDEWEWF

SEQ ID NO: 1101 - protein, 35 aa, Artificial Sequence
  Core polypeptide
WQEWEREITALLEQAQIQQEKNEYELQKLIEWEWF

SEQ ID NO: 1102 - protein, 35 aa, Artificial Sequence
  Core polypeptide
WQEWEREITALLEQAQIQQEKIEYELQKLDEWEWF

SEQ ID NO: 1103 - protein, 33 aa, Artificial Sequence
  Core polypeptide
WQEWEITALLEQAQIQQEKNEYELQKLDEWEWF

SEQ ID NO: 1104 - protein, 33 aa, Artificial Sequence
  Core polypeptide
WQEWEITALLEQAQIQQEKNEYELQKLIEWEWF

SEQ ID NO: 1105 - protein, 33 aa, Artificial Sequence
  Core polypeptide
WQEWEITALLEQAQIQQEKIEYELQKLDEWEWF

SEQ ID NO: 1106 - protein, 33 aa, Artificial Sequence
  Core polypeptide
WQEWEITALLEQAQIQQEKIEYELQKLIEWEWF

SEQ ID NO: 1107 - protein, 39 aa, Artificial Sequence
  Core polypeptide
WQEWDREIDEYDASISQVNEKINQALAYIREADELWEWF

SEQ ID NO: 1108 - protein, 39 aa, Artificial Sequence
  Core polypeptide
WQEWEREIDEYDASISQVNEKINQALAYIREADELWEWF

SEQ ID NO: 1109 - protein, 37 aa, Artificial Sequence
  Core polypeptide
WQEWEIDEYDASISQVNEKINQALAYIREADELWEWF

SEQ ID NO: 1110 - protein, 39 aa, Artificial Sequence
  Core polypeptide
WQEWDREIDEYDASISQVNEEINQALAYIREADELWEWF

SEQ ID NO: 1111 - protein, 39 aa, Artificial Sequence
  Core polypeptide
WQEWEREIDEYDASISQVNEEINQALAYIREADELWEWF

SEQ ID NO: 1112 - protein, 37 aa, Artificial Sequence
  Core polypeptide
WQEWEIDEYDASISQVNEEINQALAYIREADELWEWF

SEQ ID NO: 1113 - protein, 35 aa, Artificial Sequence
  Core polypeptide
WQEWDEYDASISQVNEKINQALAYIREADELWEWF

SEQ ID NO: 1114 - protein, 35 aa, Artificial Sequence
  Core polypeptide
WQEWDEYDASISQVNEEINQALAYIREADELWEWF

SEQ ID NO: 1115 - protein, 35 aa, Artificial Sequence
  Core polypeptide
WQEWEQKITALLEQAQIQQEKIEYELQKLIEWEWF

SEQ ID NO: 1116 - protein, 39 aa, Artificial Sequence
  Core polypeptide
WQEWEQKITALLEQAQIQQEKIEYELQKLIEWASLWEWF

SEQ ID NO: 1117 - protein, 37 aa, Artificial Sequence
  Core polypeptide
WQEWEITALLEQAQIQQEKIEYELQKLIEWASLWEWF

SEQ ID NO: 1118 - protein, 44 aa, Artificial Sequence
  Core polypeptide
NHTTWMEWDREINNYTSLIHSLIEESQNQQEKNEQELLELDKWH

SEQ ID NO: 1119 - protein, 52 aa, Artificial Sequence
  Core polypeptide
QARQLLSGIVQQQNNLLRAIEAQQHLLQLTVWGIKQLQARILAVERYLKDQH

SEQ ID NO: 1120 - protein, 40 aa, Artificial Sequence
  Core polypeptide
WVYPSDEYDASISQVNEEINQALAYIRKADELLENVWNWF

SEQ ID NO: 1121 - protein, 36 aa, Artificial Sequence; identical to SEQ ID NO: 15
  Core polypeptide

SEQ ID NO: 1122 - protein, 35 aa, Artificial Sequence
  Core polypeptide
WQEWDEYDASISQVNEKINQALAYIREADELWAWF

SEQ ID NO: 1123 - protein, 35 aa, Artificial Sequence
  Core polypeptide
WQAWDEYDASISQVNEKINQALAYIREADELWAWF

SEQ ID NO: 1124 - protein, 35 aa, Artificial Sequence
  Core polypeptide
WQAWDEYDASISQVNEKINQALAYIREADELWEWF

SEQ ID NO: 1125 - protein, 35 aa, Artificial Sequence; identical to SEQ ID NO: 104
  Core polypeptide

SEQ ID NO: 1126 - protein, 28 aa, Artificial Sequence
  Core polypeptide
YDPLVFPSDEFDASISQVNEKINQSLAF

SEQ ID NO: 1127 - protein, 29 aa, Artificial Sequence
  Core polypeptide
QVNEKINQSLAFIRKSDELLHNVNAGKST

SEQ ID NO: 1128 - protein, 8 aa, Artificial Sequence
  Core polypeptide
WMEWDREI

SEQ ID NO: 1129 - protein, 8 aa, Artificial Sequence
  Core polypeptide
WQEWEQKI

SEQ ID NO: 1130 - protein, 39 aa, Artificial Sequence
  Core polypeptide
WQEWEQKITALLEQAQIQQEKIEYELQKLIKWASLWEWF

SEQ ID NO: 1131 - protein, 39 aa, Artificial Sequence; identical to SEQ ID NO: 1116
  Core polypeptide

SEQ ID NO: 1132 - protein, 42 aa, Artificial Sequence
  Core polypeptide
WQEWEREISAYTSLITALLEQAQIQQEKIEYELQKLIEWEWF

SEQ ID NO: 1133 - protein, 40 aa, Artificial Sequence
  Core polypeptide
WQEWEREISAYTSLITALLEQAQIQQEKIEYELQKEWEWF

SEQ ID NO: 1134 - protein, 39 aa, Artificial Sequence
  Core polypeptide
WQEWEREISAYTSLITALLEQAQIQQEKIEYELQKEWEW

SEQ ID NO: 1135 - protein, 41 aa, Artificial Sequence
  Core polypeptide
WQEWEREISAYTSLITALLEQAQIQQEKIEYELQKLIEWEW

SEQ ID NO: 1136 - protein, 36 aa, Artificial Sequence
  Core polypeptide
FNLSDHSESIQKKFQLMKKHVNKIGVDSDPIGSWLR

SEQ ID NO: 1137 - protein, 35 aa, Artificial Sequence
  Core polypeptide
DHSESIQKKFQLMKKHVNKIGVDSDPIGSWLRGIF

SEQ ID NO: 1138 - protein, 40 aa, Artificial Sequence
  Core polypeptide
WSVKQANLTTSLLGDLLDDVTSIRHAVLQNRAWMEWDREI

SEQ ID NO: 1139 - protein, 18 aa, Artificial Sequence
  Core polypeptide
NNMTWMEWDREINNYTSL

SEQ ID NO: 1140 - protein, 36 aa, Artificial Sequence
  Core polypeptide
GAASLTLTVQARQLLSGIVQQQNNLLRAIEAQQHLL

SEQ ID NO: 1141 - protein, 36 aa, Artificial Sequence
  Core polypeptide
ASLTLTVQARQLLSGIVQQQNNLLRAIEAQQHLLQL

SEQ ID NO: 1142 - protein, 34 aa, Artificial Sequence
  Core polypeptide
VSVGNTLYYVNKQEGKSLYVKGEPIINFYDPLVF

SEQ ID NO: 1143 - protein, 10 aa, Artificial Sequence
  Core polypeptide
QHWSYGLRPG

SEQ ID NO: 1144 - protein, 26 aa, Artificial Sequence
  Core polypeptide
WQEWEQKIQHWSYGLRPGWASLWEWF

SEQ ID NO: 1145 - protein, 22 aa, Artificial Sequence
  Core polypeptide
WQEWEQKIQHWSYGLRPGWEWF

SEQ ID NO: 1146 - protein, 18 aa, Artificial Sequence
  Core polypeptide
WNWFQHWSYGLRPGWNWF

SEQ ID NO: 1147 - protein, 18 aa, Artificial Sequence
  Core polypeptide
FNFFQHWSYGLRPGFNFF

SEQ ID NO: 1148 - protein, 18 aa, Artificial Sequence
  Core polypeptide
GAGAQHWSYGLRPGAGAG

SEQ ID NO: 1149 - protein, 39 aa, Artificial Sequence
  Core polypeptide
WQEWEQKITALLEQAQIQQEKIEYELQKLAKWASLWEWF

SEQ ID NO: 1150 - protein, 39 aa, Artificial Sequence
  Core polypeptide
WQEWEQKITALLEQAQIQQEKIEYELQKLAEWASLWEWF

SEQ ID NO: 1151 - protein, 39 aa, Artificial Sequence
  Core polypeptide
WQEWEQKITALLEQAQIQQEKAEYELQKLAEWASLWEWF

SEQ ID NO: 1152 - protein, 39 aa, Artificial Sequence
  Core polypeptide
WQEWEQKITALLEQAQIQQEKAEYELQKLAEWASLWAWF

SEQ ID NO: 1153 - protein, 39 aa, Artificial Sequence
  Core polypeptide
WQEWEQKITALLEQAQIQQEKAEYELQKLAKWASLWAWF

SEQ ID NO: 1154 - protein, 36 aa, Artificial Sequence
  Core polypeptide
TNKAVVSLSNGVSVLTSKVLDLKNYIDKQLLPIVNK

SEQ ID NO: 1155 - protein, 36 aa, Artificial Sequence
  Core polypeptide
KAVVSLSNGVSVLTSKVLDLKNYIDKQLLPIVNKQS

SEQ ID NO: 1156 - protein, 35 aa, Artificial Sequence
  Core polypeptide
WQEWEQKITALLEQAQIQQEKNEYELQKLIEWEWF

SEQ ID NO: 1157 - protein, 35 aa, Artificial Sequence
  Core polypeptide
WQEWEQKITALLEQAQIQQEKGEYELQKLIEWEWF

SEQ ID NO: 1158 - protein, 35 aa, Artificial Sequence
  Core polypeptide
WQEWEQKITALLEQAQIQQEKIEYELQKLDKWEWF

SEQ ID NO: 1159 - protein, 28 aa, Artificial Sequence
  Core polypeptide
YDPLVFPSDEFDASISQVNEKINQSLAF

SEQ ID NO: 1160 - protein, 35 aa, Artificial Sequence; identical to SEQ ID NO: 692
  Core polypeptide

SEQ ID NO: 1161 - protein, 36 aa, Artificial Sequence; identical to SEQ ID NO: 15
  Core polypeptide

SEQ ID NO: 1162 - protein, 36 aa, Artificial Sequence
  Core polypeptide
SGIVQQQNNLLRAIEAQQHLLQLTVWGIKQLQARIL

SEQ ID NO: 1163 - protein, 41 aa, Artificial Sequence
  Core polypeptide
QQQNNLLRAIEAQQHLLQLTVWGIKQLQARILAVERYLKDQ

SEQ ID NO: 1164 - protein, 45 aa, Artificial Sequence
  Core polypeptide
SGIVQQQNNLLRAIEAQQHLLQLTVWGIKQLQARILAVERYLKDQ

SEQ ID NO: 1165 - protein, 39 aa, Artificial Sequence
  Core polypeptide
WQEWEQKITALLEQAQIQQEKNEYELQKLAEWASLWAWF

SEQ ID NO: 1166 - protein, 38 aa, Artificial Sequence
  Core polypeptide
WQEWEQKITALLEQAQIQQEKNEYELQKLAEWASLWAW

SEQ ID NO: 1167 - protein, 38 aa, Artificial Sequence
  Core polypeptide
WQEWEQKITALLEQAQIQQEKAEYELQKLAEWASLWAW

SEQ ID NO: 1168 - protein, 39 aa, Artificial Sequence
  Core polypeptide
WQEWEQKITALLEQAQIQQEKNEYELQKLAEWAGLWAWF

SEQ ID NO: 1169 - protein, 38 aa, Artificial Sequence
  Core polypeptide
WQEWEQKITALLEQAQIQQEKNEYELQKLAEWAGLWAW

SEQ ID NO: 1170 - protein, 38 aa, Artificial Sequence
  Core polypeptide
WQEWEQKITALLEQAQIQQEKAEYELQKLAEWAGLWAW

SEQ ID NO: 1171 - protein, 39 aa, Artificial Sequence
  Core polypeptide
WQEWEQKITALLEQAQIQQEKNEYELQKLDKWAGLWEWF

SEQ ID NO: 1172 - protein, 18 aa, Artificial Sequence
  Core polypeptide
WQEWQHWSYGLRPGWEWF

SEQ ID NO: 1173 - protein, 18 aa, Artificial Sequence
  Core polypeptide
WQAWQHWSYGLRPGWAWF

SEQ ID NO: 1174 - protein, 39 aa, Artificial Sequence; identical to SEQ ID NO: 1071
  Core polypeptide

SEQ ID NO: 1175 - protein, 39 aa, Artificial Sequence; identical to SEQ ID NO: 1071
  Core polypeptide

SEQ ID NO: 1176 - protein, 35 aa, Artificial Sequence; identical to SEQ ID NO: 1115
  Core polypeptide

SEQ ID NO: 1177 - protein, 34 aa, Artificial Sequence
  Core polypeptide
WQEWEQKIALLEQAQIQQEKIEYELQKLIEWEWF

SEQ ID NO: 1178 - protein, 38 aa, Artificial Sequence
  Core polypeptide
WQEWEQKIALLEQAQIQQEKNEYELQKLDKWASLWEWF

SEQ ID NO: 1179 - protein, 38 aa, Artificial Sequence
  Core polypeptide
AGSTMGARSMTLTVQARQLLSGIVQQQNNLLRAIEAQQ

SEQ ID NO: 1180 - protein, 38 aa, Artificial Sequence
  Core polypeptide
AGSAMGAASLTLSAQSRTLLAGIVQQQQQLLDVVKRQQ

SEQ ID NO: 1181 - protein, 38 aa, Artificial Sequence
  Core polypeptide
AGSAMGAASTALTAQSRTLLAGIVQQQQQLLDVVKRQQ

SEQ ID NO: 1182 - protein, 38 aa, Artificial Sequence
  Core polypeptide
ALTAQSRTLLAGIVQQQQQLLDVVKRQQELLRLTVWGT

SEQ ID NO: 1183 - protein, 38 aa, Artificial Sequence
  Core polypeptide
TLSAQSRTLLAGIVQQQQQLLDVVKRQQEMLRLTVWGT

SEQ ID NO: 1184 - protein, 38 aa, Artificial Sequence
  Core polypeptide
TLTVQARQLLSGIVQQQNNLLRAIEAQQHLLQLTVWGI

SEQ ID NO: 1185 - protein, 35 aa, Artificial Sequence
  Core polypeptide
WQAWIEYEAELSQVKEKIEQSLAYIREADELWAWF

SEQ ID NO: 1186 - protein, 35 aa, Artificial Sequence
  Core polypeptide
WQAWIEYEASLSQAKEKIEESKAYIREADELWAWF

SEQ ID NO: 1187 - protein, 35 aa, Artificial Sequence
  Core polypeptide
WQAWIEYERLLVQAKLKIAIAKLYIAKELLEWAWF

SEQ ID NO: 1188 - protein, 35 aa, Artificial Sequence
  Core polypeptide
WQAWIEYERLLVQVKLKIAIALLYIAKELLEWAWF

SEQ ID NO: 1189 - protein, 35 aa, Artificial Sequence
  Core polypeptide
WQAWIELERLLVQVKLKLAIAKLEIAKELLEWAWF

SEQ ID NO: 1190 - protein, 19 aa, Artificial Sequence
  Core polypeptide
GEWTYDDATKTFTVTEGGH

SEQ ID NO: 1191 - protein, 35 aa, Artificial Sequence
  Core polypeptide
WQEWEQKIGEWTYDDATKTFTVTEGGHWASLWEWF

SEQ ID NO: 1192 - protein, 16 aa, Artificial Sequence
  Core polypeptide
GEWTYDDATKTFTVTE

SEQ ID NO: 1193 - protein, 32 aa, Artificial Sequence
  Core polypeptide
WQEWEQKIGEWTYDDATKTFTVTEWASLWEWF

SEQ ID NO: 1194 - protein, 8 aa, Artificial Sequence
  Core polypeptide
MHRFDYRT

SEQ ID NO: 1195 - protein, 24 aa, Artificial Sequence
  Core polypeptide
WQEWEQKIMHRFDYRTWASLWEWF

SEQ ID NO: 1196 - protein, 11 aa, Artificial Sequence
  Core polypeptide
MHRFNWSTGGG

SEQ ID NO: 1197 - protein, 27 aa, Artificial Sequence
  Core polypeptide
WQEWEQKIMHRFNWSTGGGWASLWEWF

SEQ ID NO: 1198 - protein, 8 aa, Artificial Sequence
  Core polypeptide
MHRFNWST

SEQ ID NO: 1199 - protein, 24 aa, Artificial Sequence
  Core polypeptide
WQEWEQKIMHRFNWSTWASLWEWF

SEQ ID NO: 1200 - protein, 18 aa, Artificial Sequence
  Core polypeptide
LLVPLARIMTMSSVHGGG

SEQ ID NO: 1201 - protein, 34 aa, Artificial Sequence
  Core polypeptide
WQEWEQKILLVPLARIMTMSSVHGGGWASLWEWF

SEQ ID NO: 1202 - protein, 15 aa, Artificial Sequence
  Core polypeptide
LLVPLARIMTMSSVH

SEQ ID NO: 1203 - protein, 31 aa, Artificial Sequence
  Core polypeptide
WQEWEQKILLVPLARIMTMSSVHWASLWEWF

SEQ ID NO: 1204 - protein, 23 aa, Artificial Sequence
  Core polypeptide
TALLEQAQIQQEKNEYELQKLDK

SEQ ID NO: 1205 - protein, 23 aa, Artificial Sequence
  Core polypeptide
TALLEQAQIQQEKNEYELQKLDK

SEQ ID NO: 1206 - protein, 23 aa, Artificial Sequence
  Core polypeptide
TALLEQAQIQQEKIEYELQKLIE

SEQ ID NO: 1207 - protein, 23 aa, Artificial Sequence
  Core polypeptide
TALLEQAQIQQEKIEYELQKLIE

SEQ ID NO: 1208 - protein, 47 aa, Artificial Sequence
  Core polypeptide
QARQLLSGIVQQQNNLLRAIEAQQHLLQLTVWGIKQLQARILAVERY

SEQ ID NO: 1209 - protein, 47 aa, Artificial Sequence; identical to SEQ ID NO: 1208
  Core polypeptide

SEQ ID NO: 1210 - protein, 36 aa, Artificial Sequence
  Core polypeptide
GAASLTLSAQSRTLLAGIVQQQQQLLDVVKRQQEML

SEQ ID NO: 1211 - protein, 40 aa, Artificial Sequence
  Core polypeptide
GSAMGAASLTLSAQSRTLLAGIVQQQQQLLDVVKRQQEML

SEQ ID NO: 1212 - protein, 36 aa, Artificial Sequence
  Core polypeptide
PALSTGLIHLHQNIVDVQFLFGVGSSIASWAIKWEY

SEQ ID NO: 1213 - protein, 33 aa, Artificial Sequence
  Core polypeptide
PALSTGLIHLHQNIVDVQFLYGVGSSIASWAIK

SEQ ID NO: 1214 - protein, 34 aa, Artificial Sequence
  Core polypeptide
LSTTQWQVLPSFTTLPALSTGLIHLHQNIVDVQY

SEQ ID NO: 1215 - protein, 31 aa, Artificial Sequence
  Core polypeptide
FRKFPEATFSRGSGPRITPRMVDFPFRLWHY

SEQ ID NO: 1216 - protein, 37 aa, Artificial Sequence
  Core polypeptide
DFPFRLWHFPTINYTIFKVRLFVGGVEHRLEAANWTR

SEQ ID NO: 1217 - protein, 32 aa, Artificial Sequence
  Core polypeptide
YVGGVEHRLEAANWTRGERDLEDRDRSELSPL

SEQ ID NO: 1218 - protein, 36 aa, Artificial Sequence
  Core polypeptide
MVYPSDEYDASISQVNEEINQALAYIRKADELLENV

SEQ ID NO: 1219 - protein, 36 aa, Artificial Sequence; identical to SEQ ID NO: 1218
  Core polypeptide

SEQ ID NO: 1220 - protein, 35 aa, Artificial Sequence
  Core polypeptide
GPLLVLQAGFFLLTRILTIPQSLDSWWTSLNFLGG

SEQ ID NO: 1221 - protein, 35 aa, Artificial Sequence
  Core polypeptide
LGPLLVLQAGFFLLTRILTIPQSLDSWWTSLNFLG

SEQ ID NO: 1222 - protein, 35 aa, Artificial Sequence
  Core polypeptide
FLGPLLVLQAGFFLLTRILTIPQSLDSWWTSLNFL

SEQ ID NO: 1223 - protein, 36 aa, Artificial Sequence
  Core polypeptide
YTSLIGSLIEESQIQQERNEQELLELDRWASLWEWF

SEQ ID NO: 1224 - protein, 34 aa, Artificial Sequence
  Core polypeptide
VYPSDEYDASISQVNEEINQALAYIRKADELLEH

SEQ ID NO: 1225 - protein, 33 aa, Artificial Sequence
  Core polypeptide
VYPSDEYDASISQVNEEINQALAYIRKADELLH

SEQ ID NO: 1226 - protein, 32 aa, Artificial Sequence
  Core polypeptide
VYPSDEYDASISQVNEEINQALAYIRKADELH

SEQ ID NO: 1227 - protein, 34 aa, Artificial Sequence
  Core polypeptide
YPSDEYDASISQVNEEINQALAYIRKADELLENV

SEQ ID NO: 1228 - protein, 33 aa, Artificial Sequence
  Core polypeptide
PSDEYDASISQVNEEINQALAYIRKADELLENV

SEQ ID NO: 1229 - protein, 32 aa, Artificial Sequence
  Core polypeptide
SDEYDASISQVNEEINQALAYIRKADELLENV

SEQ ID NO: 1230 - protein, 31 aa, Artificial Sequence
  Core polypeptide
DEYDASISQVNEEINQALAYIRKADELLENV

SEQ ID NO: 1231 - protein, 35 aa, Artificial Sequence
  Core polypeptide
VYPSDEYDASISQVDEEINQALAYIRKADELLENV

SEQ ID NO: 1232 - protein, 35 aa, Artificial Sequence
  Core polypeptide
VYPSDEYDASISQVNEEIDQALAYIRKADELLENV

SEQ ID NO: 1233 - protein, 35 aa, Artificial Sequence
  Core polypeptide
VYPSDEYDASISQVNEEINQALAYIRKADELLEDV

SEQ ID NO: 1234 - protein, 35 aa, Artificial Sequence
  Core polypeptide
VYPSDEYDASISQVDEEIDQALAYIRKADELLENV

SEQ ID NO: 1235 - protein, 35 aa, Artificial Sequence
  Core polypeptide
LLSTNKAVVSLSNGVSVLTSKVLDLKNYIDKQLLP

SEQ ID NO: 1236 - protein, 35 aa, Artificial Sequence
  Core polypeptide
LSTNKAVVSLSNGVSVLTSKVLDLKNYIDKQLLPI

SEQ ID NO: 1237 - protein, 35 aa, Artificial Sequence; identical to SEQ ID NO: 692
  Core polypeptide

SEQ ID NO: 1238 - protein, 27 aa, Artificial Sequence
  Core polypeptide
DEYDASISQVNEEINQALAYIREADEL

SEQ ID NO: 1239 - protein, 27 aa, Artificial Sequence
  Core polypeptide
DEYDASISQVNEKINQALAYIREADEL

SEQ ID NO: 1240 - protein, 35 aa, Artificial Sequence
  Core polypeptide
DDECLNSVKNGTYDFPKFEEESKLNRNEIKGVKLS

SEQ ID NO: 1241 - protein, 36 aa, Artificial Sequence
  Core polypeptide
DDEABLNSVKNGTYDFPKFEEESKLNRNEIKGVKLS

SEQ ID NO: 1242 - protein, 40 aa, Artificial Sequence
  Core polypeptide
YHKCDDECLNSVKNGTFDFPKFEEESKLNRNEIKGVKLSS

SEQ ID NO: 1243 - protein, 42 aa, Artificial Sequence
  Core polypeptide
YHKABDDEABLNSVKNGTFDFPKFEEESKLNRNEIKGVKLSS

SEQ ID NO: 1244 - protein, 36 aa, Artificial Sequence
  Core polypeptide
YTSLIHSLIEESQIQQEKNEYELQKLDKWASLWNWF

SEQ ID NO: 1245 - protein, 36 aa, Artificial Sequence
  Core polypeptide
YTSLIHSLIEESQNQQEKNEQELQKLDKWASLWNWF

SEQ ID NO: 1246 - protein, 36 aa, Artificial Sequence
  Core polypeptide
YTSLIHSLIEESQNQQEKNEYELQKLDKWASLWNWF

SEQ ID NO: 1247 - protein, 36 aa, Artificial Sequence
  Core polypeptide
YTSLIHSLIEESQIQQEKNEQELQKLDKWASLWNWF

SEQ ID NO: 1248 - protein, 36 aa, Artificial Sequence
  Core polypeptide
YTSLIHSLIEESQNQQEKNEQELLELDKWASLWEWF

SEQ ID NO: 1249 - protein, 36 aa, Artificial Sequence
  Core polypeptide
YTSLIHSLIEESQIQQEKNEQELLELDKWASLWEWF

SEQ ID NO: 1250 - protein, 36 aa, Artificial Sequence
  Core polypeptide
YTSLIHSLIEESQNQQEKNEYELLELDKWASLWEWF

SEQ ID NO: 1251 - protein, 36 aa, Artificial Sequence
  Core polypeptide
YTSLIHSLIEESQIQQEKNEYELLELDKWASLWEWF

SEQ ID NO: 1252 - protein, 36 aa, Artificial Sequence
  Core polypeptide
YTSLIHSLIEESQIQQEKNEYELQKLDKWASLWEWF

SEQ ID NO: 1253 - protein, 36 aa, Artificial Sequence
  Core polypeptide
YTSLIHSLIEESQNQQEKNEQELQKLDKWASLWEWF

SEQ ID NO: 1254 - protein, 36 aa, Artificial Sequence
  Core polypeptide
YTSLIHSLIEESQNQQEKNEYELQKLDKWASLWEWF

SEQ ID NO: 1255 - protein, 36 aa, Artificial Sequence
  Core polypeptide
YTSLIHSLIEESQIQQEKNEQELQKLDKWASLWEWF

SEQ ID NO: 1256 - protein, 39 aa, Artificial Sequence
  Core polypeptide
WQEWEQKITALLEQAQIQQEKNEYELQKLAKWASLWEWF

SEQ ID NO: 1257 - protein, 39 aa, Artificial Sequence
  Core polypeptide
WQEWEQKITALLEQAQIQQEKNEYELQKLIKWASLWEWF

SEQ ID NO: 1258 - protein, 39 aa, Artificial Sequence
  Core polypeptide
WQEWEQKITALLEQAQIQQEKNEYELQKLIEWAGLWEWF

SEQ ID NO: 1259 - protein, 39 aa, Artificial Sequence
  Core polypeptide
WQEWEQKITALLEQAQIQQEKNEYELQKLIKWAGLWEWF

SEQ ID NO: 1260 - protein, 39 aa, Artificial Sequence
  Core polypeptide
WQEWEQKITALLEQAQIQQEKNEYELQKLAKWAGLWEWF

SEQ ID NO: 1261 - protein, 39 aa, Artificial Sequence
  Core polypeptide
WQEWEQKITALLEQAQIQQEKNEYELQKLIEWAGLWAWF

SEQ ID NO: 1262 - protein, 39 aa, Artificial Sequence
  Core polypeptide
WQEWEQKITALLEQAQIQQEKNEYELQKLAKWAGLWAWF

SEQ ID NO: 1263 - protein, 39 aa, Artificial Sequence
  Core polypeptide
WQEWEQKITALLEQAQIQQEKNEYELQKLIKWAGLWAWF

SEQ ID NO: 1264 - protein, 35 aa, Artificial Sequence
  Core polypeptide
WQEWEQKITALLEQAQIQQEKGEYELQKLDKWEWF

SEQ ID NO: 1265 - protein, 35 aa, Artificial Sequence
  Core polypeptide
WQEWEQKITALLEQAQIQQEKGEYELLELDKWEWF

SEQ ID NO: 1266 - protein, 35 aa, Artificial Sequence
  Core polypeptide
WQEWEQKITALLEQAQIQQEKGEYELQKLAKWEWF

SEQ ID NO: 1267 - protein, 35 aa, Artificial Sequence
  Core polypeptide
WQEWEQKITALLEQAQIQQEKGEYELQKLDEWEWF

SEQ ID NO: 1268 - protein, 35 aa, Artificial Sequence
  Core polypeptide
WQEWEQKITALLEQAQIQQEKGEYELLELAKWEWF

SEQ ID NO: 1269 - protein, 35 aa, Artificial Sequence
  Core polypeptide
WQEWEQKITALLEQAQIQQEKNEYELLELDKWEWF

SEQ ID NO: 1270 - protein, 39 aa, Artificial Sequence
  Core polypeptide
WQEWEQKITALLEQAQIQQEKNEYELLELIEWASLWEWF

SEQ ID NO: 1271 - protein, 39 aa, Artificial Sequence
  Core polypeptide
WQEWEQKITALLEQAQIQQEKNEYELLELIEWAGLWEWF

SEQ ID NO: 1272 - protein, 39 aa, Artificial Sequence
  Core polypeptide
WQEWEQKITALLEQAQIQQEKNEYELLELIEWAGLWAWF

SEQ ID NO: 1273 - protein, 39 aa, Artificial Sequence
  Core polypeptide
WQEWEREITALLEQAQIQQEKNEYELQKLIEWASLWEWF

SEQ ID NO: 1274 - protein, 30 aa, Artificial Sequence
  Core polypeptide
WQEWEREIQQEKNEYELQKLDKWASLWEWF

SEQ ID NO: 1275 - protein, 25 aa, Artificial Sequence
  Core polypeptide
WQEWEREIQQEKGEYELQKLEWEWF

SEQ ID NO: 1276 - protein, 29 aa, Artificial Sequence
  Core polypeptide
WQEWQAQIQQEKNEYELQKLDWASLWEWF

SEQ ID NO: 1277 - protein, 26 aa, Artificial Sequence
  Core polypeptide
WQEWQAQIQQEKGEYELQKLIEWEWF

SEQ ID NO: 1278 - protein, 28 aa, Artificial Sequence
  Core polypeptide
YTSLIHSLIEESQNQQEKNEQELLELDK

SEQ ID NO: 1279 - protein, 28 aa, Artificial Sequence
  Core polypeptide
LEENITALLEEAQIQQEKNMYELQKLNS

SEQ ID NO: 1280 - protein, 28 aa, Artificial Sequence
  Core polypeptide
LEANISQSLEQAQIQQEKNMYELQKLNS

SEQ ID NO: 1281 - protein, 28 aa, Artificial Sequence
  Core polypeptide
NNYTSLIHSLIEESQNQQEKNEQELLEL

SEQ ID NO: 1282 - protein, 28 aa, Artificial Sequence
  Core polypeptide
DFLEENITALLEEAQIQQEKNMYELQKL

SEQ ID NO: 1283 - protein, 28 aa, Artificial Sequence
  Core polypeptide
RYLEANISQSLEQAQIQQEKNMYELQKL

SEQ ID NO: 1284 - protein, 28 aa, Artificial Sequence
  Core polypeptide
RYLEANITALLEQAQIQQEKNEYELQKL

SEQ ID NO: 1285 - protein, 30 aa, Artificial Sequence
  Core polypeptide
NNYTSLIHSLIEESQNQQEKNEQELLELDK

SEQ ID NO: 1286 - protein, 23 aa, Artificial Sequence
  Core polypeptide
TALLEQAQIQQEKNEYELQKLDK

SEQ ID NO: 1287 - protein, 23 aa, Artificial Sequence
  Core polypeptide
TALLEQAQIQQEKNEYELQKLDE

SEQ ID NO: 1288 - protein, 23 aa, Artificial Sequence
  Core polypeptide
TALLEQAQIQQEKNEYELQKLIE

SEQ ID NO: 1289 - protein, 23 aa, Artificial Sequence
  Core polypeptide
TALLEQAQIQQEKIEYELQKLDK

SEQ ID NO: 1290 - protein, 23 aa, Artificial Sequence
  Core polypeptide
TALLEQAQIQQEKIEYELQKLDE

SEQ ID NO: 1291 - protein, 23 aa, Artificial Sequence
  Core polypeptide
TALLEQAQIQQEKIEYELQKLIE

SEQ ID NO: 1292 - protein, 22 aa, Artificial Sequence
  Core polypeptide
TALLEQAQIQQEKIEYELQKLE

SEQ ID NO: 1293 - protein, 23 aa, Artificial Sequence
  Core polypeptide
TALLEQAQIQQEKIEYELQKLAK

SEQ ID NO: 1294 - protein, 23 aa, Artificial Sequence
  Core polypeptide
TALLEQAQIQQEKIEYELQKLAE

SEQ ID NO: 1295 - protein, 22 aa, Artificial Sequence
  Core polypeptide
TALLEQAQIQQEKAEYELQKLE

SEQ ID NO: 1296 - protein, 22 aa, Artificial Sequence
  Core polypeptide
TALLEQAQIQQEKNEYELQKLE

SEQ ID NO: 1297 - protein, 22 aa, Artificial Sequence
  Core polypeptide
TALLEQAQIQQEKGEYELQKLE

SEQ ID NO: 1298 - protein, 23 aa, Artificial Sequence
  Core polypeptide
TALLEQAQIQQEKAEYELQKLAK

SEQ ID NO: 1299 - protein, 23 aa, Artificial Sequence
  Core polypeptide
TALLEQAQIQQEKNEYELQKLAK

SEQ ID NO: 1300 - protein, 23 aa, Artificial Sequence
  Core polypeptide
TALLEQAQIQQEKGEYELQKLAK

SEQ ID NO: 1301 - protein, 23 aa, Artificial Sequence
  Core polypeptide
TALLEQAQIQQEKAEYELQKLAE

SEQ ID NO: 1302 - protein, 23 aa, Artificial Sequence
  Core polypeptide
TALLEQAQIQQEKNEYELQKLAE

SEQ ID NO: 1303 - protein, 23 aa, Artificial Sequence
  Core polypeptide
TALLEQAQIQQEKGEYELQKLAE

SEQ ID NO: 1304 - protein, 28 aa, Artificial Sequence
  Core polypeptide
DEFDASISQVNEKINQSLAFIRKSDELL

SEQ ID NO: 1305 - protein, 27 aa, Artificial Sequence
  Core polypeptide
DEYDASISQVNEKINQALAYIREADEL

SEQ ID NO: 1306 - protein, 27 aa, Artificial Sequence
  Core polypeptide
DEYDASISQVNEEINQALAYIRKADEL

SEQ ID NO: 1307 - protein, 28 aa, Artificial Sequence
  Core polypeptide
DEFDESISQVNEKIEESLAFIRKSDELL

SEQ ID NO: 1308 - protein, 27 aa, Artificial Sequence
  Core polypeptide
DEFDESISQVNEKIEESLAFIRKSDEL

SEQ ID NO: 1309 - protein, 10 aa, Artificial Sequence
  Core polypeptide
QHWSYGLRPG

SEQ ID NO: 1310 - protein, 39 aa, Artificial Sequence; identical to SEQ ID NO: 1071
  Core polypeptide

SEQ ID NO: 1311 - protein, 35 aa, Artificial Sequence; identical to SEQ ID NO: 1115
  Core polypeptide

SEQ ID NO: 1312 - protein, 35 aa, Artificial Sequence; identical to SEQ ID NO: 692
  Core polypeptide

SEQ ID NO: 1313 - protein, 28 aa, Artificial Sequence
  Core polypeptide
YTSLIHSLIEESQNQQEKNEQELLELDK

SEQ ID NO: 1314 - protein, 28 aa, Artificial Sequence
  Core polypeptide
LEENITALLEEAQIQQEKNMYELQKLNS

SEQ ID NO: 1315 - protein, 28 aa, Artificial Sequence
  Core polypeptide
LEANISQSLEQAQIQQEKNMYELQKLNS

SEQ ID NO: 1316 - protein, 28 aa, Artificial Sequence
  Core polypeptide
NNYTSLIHSLIEESQNQQEKNEQELLEL

SEQ ID NO: 1317 - protein, 28 aa, Artificial Sequence
  Core polypeptide
DFLEENITALLEEAQIQQEKNMYELQKL

SEQ ID NO: 1318 - protein, 28 aa, Artificial Sequence
  Core polypeptide
RYLEANISQSLEQAQIQQEKNMYELQKL

SEQ ID NO: 1319 - protein, 28 aa, Artificial Sequence
  Core polypeptide
RYLEANITALLEQAQIQQEKNEYELQKL

SEQ ID NO: 1320 - protein, 30 aa, Artificial Sequence; identical to SEQ ID NO: 1285
  Core polypeptide

SEQ ID NO: 1321 - protein, 23 aa, Artificial Sequence
  Core polypeptide
TALLEQAQIQQEKNEYELQKLDK

SEQ ID NO: 1322 - protein, 23 aa, Artificial Sequence
  Core polypeptide
TALLEQAQIQQEKNEYELQKLDE

SEQ ID NO: 1323 - protein, 23 aa, Artificial Sequence
  Core polypeptide
TALLEQAQIQQEKNEYELQKLIE

SEQ ID NO: 1324 - protein, 23 aa, Artificial Sequence
  Core polypeptide
TALLEQAQIQQEKIEYELQKLDK

SEQ ID NO: 1325 - protein, 23 aa, Artificial Sequence
  Core polypeptide
TALLEQAQIQQEKIEYELQKLDE

SEQ ID NO: 1326 - protein, 23 aa, Artificial Sequence
  Core polypeptide
TALLEQAQIQQEKIEYELQKLIE

SEQ ID NO: 1327 - protein, 22 aa, Artificial Sequence
  Core polypeptide
TALLEQAQIQQEKIEYELQKLE

SEQ ID NO: 1328 - protein, 23 aa, Artificial Sequence
  Core polypeptide
TALLEQAQIQQEKIEYELQKLAK

SEQ ID NO: 1329 - protein, 23 aa, Artificial Sequence
  Core polypeptide
TALLEQAQIQQEKIEYELQKLAE

SEQ ID NO: 1330 - protein, 22 aa, Artificial Sequence
  Core polypeptide
TALLEQAQIQQEKAEYELQKLE

SEQ ID NO: 1331 - protein, 22 aa, Artificial Sequence
  Core polypeptide
TALLEQAQIQQEKNEYELQKLE

SEQ ID NO: 1332 - protein, 22 aa, Artificial Sequence
  Core polypeptide
TALLEQAQIQQEKGEYELQKLE

SEQ ID NO: 1333 - protein, 23 aa, Artificial Sequence
  Core polypeptide
TALLEQAQIQQEKAEYELQKLAK

SEQ ID NO: 1334 - protein, 23 aa, Artificial Sequence
  Core polypeptide
TALLEQAQIQQEKNEYELQKLAK

SEQ ID NO: 1335 - protein, 23 aa, Artificial Sequence
  Core polypeptide
TALLEQAQIQQEKGEYELQKLAK

SEQ ID NO: 1336 - protein, 23 aa, Artificial Sequence
  Core polypeptide
TALLEQAQIQQEKAEYELQKLAE

SEQ ID NO: 1337 - protein, 23 aa, Artificial Sequence
  Core polypeptide
TALLEQAQIQQEKNEYELQKLAE

SEQ ID NO: 1338 - protein, 23 aa, Artificial Sequence
  Core polypeptide
TALLEQAQIQQEKGEYELQKLAE

SEQ ID NO: 1339 - protein, 28 aa, Artificial Sequence
  Core polypeptide
DEFDASISQVNEKINQSLAFIRKSDELL

SEQ ID NO: 1340 - protein, 27 aa, Artificial Sequence
  Core polypeptide
DEYDASISQVNEKINQALAYIREADEL

SEQ ID NO: 1341 - protein, 27 aa, Artificial Sequence
  Core polypeptide
DEYDASISQVNEEINQALAYIRKADEL

SEQ ID NO: 1342 - protein, 28 aa, Artificial Sequence
  Core polypeptide
DEFDESISQVNEKIEESLAFIRKSDELL

SEQ ID NO: 1343 - protein, 27 aa, Artificial Sequence
  Core polypeptide
DEFDESISQVNEKIEESLAFIRKSDEL

SEQ ID NO: 1344 - protein, 10 aa, Artificial Sequence
  Core polypeptide
QHWSYGLRPG

SEQ ID NO: 1345 - protein, 35 aa, Artificial Sequence
  Core polypeptide
GLSPTVWLSVIWMMWYWGPSLYSILSPFLPLLPIF

SEQ ID NO: 1346 - protein, 36 aa, Artificial Sequence
  Core polypeptide
VGLSPTVWLSVIWMMWYWWGPSLYSILSPFLPLLPI

SEQ ID NO: 1347 - protein, 35 aa, Artificial Sequence
  Core polypeptide
FVGLSPTVWLSVIWMMWYWGPSLYSILSPFLPLLP

SEQ ID NO: 1348 - protein, 35 aa, Artificial Sequence
  Core polypeptide
WFVGLSPTVWLSVIWMMWYWGPSLYSILSPFLPLL

SEQ ID NO: 1349 - protein, 35 aa, Artificial Sequence
  Core polypeptide
QWFVGLSPTVWLSVIWMMWYWGPSLYSILSPFLPL

SEQ ID NO: 1350 - protein, 35 aa, Artificial Sequence
  Core polypeptide
VQWFVGLSPTVWLSVIWMMWYWGPSLYSILSPFLP

SEQ ID NO: 1351 - protein, 35 aa, Artificial Sequence
  Core polypeptide
FVQWFVGLSPTVWLSVIWMMWYWGPSLYSILSPFL

SEQ ID NO: 1352 - protein, 35 aa, Artificial Sequence
  Core polypeptide
PFVQWFVGLSPTVWLSVIWMMWYWGPSLYSILSPF

SEQ ID NO: 1353 - protein, 35 aa, Artificial Sequence
  Core polypeptide
VPFVQWFVGLSPTVWLSVIWMMWYWGPSLYSILSP

SEQ ID NO: 1354 - protein, 35 aa, Artificial Sequence
  Core polypeptide
LVPFVQWFVGLSPTVWLSVIWMMWYWGPSLYSILS

SEQ ID NO: 1355 - protein, 35 aa, Artificial Sequence
  Core polypeptide
LQAGFFLLTRILTIPQSLDSWWTSLNFLGGTTVAL

SEQ ID NO: 1356 - protein, 36 aa, Artificial Sequence
  Core polypeptide
WNWFIHSLIEESQNQQEKNEQELLELDKWASLWNWF

SEQ ID NO: 1357 - protein, 36 aa, Artificial Sequence
  Core polypeptide
YTNTIYTLLEESQNQQEKNEQELLELDKWASLWNWF

SEQ ID NO: 1358 - protein, 36 aa, Artificial Sequence
  Core polypeptide
YTGIIYNLLEESQNQQEKNEQELLELDKWANLWNWF

SEQ ID NO: 1359 - protein, 36 aa, Artificial Sequence; identical to SEQ ID NO: 1358
  Core polypeptide

SEQ ID NO: 1360 - protein, 36 aa, Artificial Sequence
  Core polypeptide
YTSLIYSLLEKSQIQQEKNEQELLELDKWASLWNWF

SEQ ID NO: 1361 - protein, 36 aa, Artificial Sequence
  Core polypeptide
YTSLIYSLLEKSQIQQEKNEQELLQLDKWASLWNWF

SEQ ID NO: 1362 - protein, 21 aa, Artificial Sequence
  Core polypeptide
EKSQIQQEKNEQELLELDKWA

SEQ ID NO: 1363 - skipped
  Core polypeptide

SEQ ID NO: 1364 - protein, 21 aa, Artificial Sequence
  Core polypeptide
EQAQIQQEKNEYELQKLDKWA

SEQ ID NO: 1365 - protein, 21 aa, Artificial Sequence
  Core polypeptide
EQAQIQQEKNEYELQKLDKWA

SEQ ID NO: 1366 - protein, 36 aa, Artificial Sequence
  Core polypeptide
  SITE (3)...(3): Xaa=unknown amino acid
  SITE (10)...(10): Xaa=unknown amino acid
  SITE (17)...(17): Xaa=unknown amino acid
  SITE (24)...(24): Xaa=unknown amino acid
YTXLIHSLIXESQNQQXKNEQELXELDKWASLWNWF

SEQ ID NO: 1367 - protein, 27 aa, Artificial Sequence
  Core polypeptide
  SITE (3)...(3): Xaa=unknown amino acid
  SITE (10)...(10): Xaa=unknown amino acid
  SITE (17)...(17): Xaa=unknown amino acid
  SITE (24)...(24): Xaa=unknown amino acid
YTXLIHSLIXESQNQQXKNEQELXELD

SEQ ID NO: 1368 - protein, 27 aa, Artificial Sequence
  Core polypeptide
YTSLIHSLIEESQNQQEKNEQELLELD

SEQ ID NO: 1369 - protein, 39 aa, Artificial Sequence
  Core polypeptide
  SITE (6)...(6): Xaa=unknown amino acid
  SITE (13)...(13): Xaa=unknown amino acid
  SITE (20)...(20): Xaa=unknown amino acid
  SITE (27)...(27): Xaa=unknown amino acid
WQEWEXKITALLXQAQIQQXKNEYELXKLDKWASLWEWF

SEQ ID NO: 1370 - protein, 34 aa, Artificial Sequence
  Core polypeptide
  SITE (1)...(1): Xaa=unknown amino acid
  SITE (8)...(8): Xaa=unknown amino acid
  SITE (15)...(15): Xaa=unknown amino acid
  SITE (22)...(22): Xaa=unknown amino acid
XKITALLXQAQIQQXKNEYELXKLDKWASLWEWF

SEQ ID NO: 1371 - protein, 30 aa, Artificial Sequence
  Core polypeptide
  SITE (6)...(6): Xaa=unknown amino acid
  SITE (13)...(13): Xaa=unknown amino acid
  SITE (20)...(20): Xaa=unknown amino acid
  SITE (27)...(27): Xaa=unknown amino acid
WQEWEXKITALLXQAQIQQXKNEYELXKLD

SEQ ID NO: 1372 - protein, 27 aa, Artificial Sequence
  Core polypeptide
WEQKITALLEQAQIQQEKNEYELQKLD

SEQ ID NO: 1373 - protein, 25 aa, Artificial Sequence
  Core polypeptide
  SITE (3)...(3): Xaa=unknown amino acid
  SITE (10)...(10): Xaa=unknown amino acid
  SITE (15)...(15): Xaa=unknown amino acid
  SITE (22)...(22): Xaa=unknown amino acid
WEXKITALLXQAQQXKNEYELXKLD

SEQ ID NO: 1374 - protein, 25 aa, Artificial Sequence
  Core polypeptide
  SITE (1)...(1): Xaa=unknown amino acid
  SITE (8)...(8): Xaa=unknown amino acid
  SITE (15)...(15): Xaa=unknown amino acid
  SITE (22)...(22): Xaa=unknown amino acid
XKITALLXQAQIQQXKNEYELXKLD

SEQ ID NO: 1375 - protein, 25 aa, Artificial Sequence
  Core polypeptide
QKITALLEQAQIQQEKNEYELQKLD

SEQ ID NO: 1376 - protein, 32 aa, Artificial Sequence
  Core polypeptide
VYPSDEYDASISQVNEEINQALAYIRKADELL

SEQ ID NO: 1377 - protein, 25 aa, Artificial Sequence
  Core polypeptide
QKITALLEQAQIQQEKNEYELQKLD

SEQ ID NO: 1378 - protein, 31 aa, Artificial Sequence
  Core polypeptide
VYPSDEYDASISQVNEEINQALAYIRKADEL

SEQ ID NO: 1379 - protein, 30 aa, Artificial Sequence
  Core polypeptide
WQEWEQKITALLEQAQIQQEKNEYELQKLD

SEQ ID NO: 1380 - protein, 34 aa, Artificial Sequence
  Core polypeptide
VYPSDEYDASISQVNEEINQALAYIRKADELLEN

SEQ ID NO: 1381 - protein, 34 aa, Artificial Sequence
  Core polypeptide
QKITALLEQAQIQQEKNEYELQKLDKWASLWEWF

SEQ ID NO: 1382 - protein, 35 aa, Artificial Sequence
  Core polypeptide
STNKAVVSLSNGVSVLTSKVLDLKNYIDKQLLPIV

SEQ ID NO: 1383 - protein, 35 aa, Artificial Sequence
  Core polypeptide
TNKAVVSLSNGVSVLTSKVLDLKNYIDKQLLPIVN

SEQ ID NO: 1384 - protein, 35 aa, Artificial Sequence
  Core polypeptide
NKAVVSLSNGVSVLTSKVLDLKNYIDKQLLPIVNK

SEQ ID NO: 1385 - protein, 35 aa, Artificial Sequence
  Core polypeptide
KAVVSLSNGVSVLTSKVLDLKNYIDKQLLPIVNKQ

SEQ ID NO: 1386 - protein, 36 aa, Artificial Sequence
  Core polypeptide
AVVSLSNGVSVLTSKVLDLLKNYIDKQLLPIVNKQS

SEQ ID NO: 1387 - protein, 34 aa, Artificial Sequence
  Core polypeptide
VVSLSNGVSVLTSKVLDLKNYIDKQLLPIVNKQS

SEQ ID NO: 1388 - protein, 34 aa, Artificial Sequence
  Core polypeptide
VSLSNGVSVLTSKVLDLKNYIDKQLLPIVNKQSS

SEQ ID NO: 1389 - protein, 34 aa, Artificial Sequence
  Core polypeptide
SLSNGVSVLTSKVLDLKNYIDKQLLPIVNKQSSI

SEQ ID NO: 1390 - protein, 34 aa, Artificial Sequence
  Core polypeptide
LSNGVSVLTSKVLDLKNYIDKQLLPIVNKQSSIS

SEQ ID NO: 1391 - protein, 34 aa, Artificial Sequence
  Core polypeptide
SNGVSVLTSKVLDLKNYIDKQLLPIVNKQSSISN

SEQ ID NO: 1392 - protein, 34 aa, Artificial Sequence
  Core polypeptide
NGVSVLTSKVLDLKNYIDKQLLPIVNKQSSISNI

SEQ ID NO: 1393 - protein, 34 aa, Artificial Sequence
  Core polypeptide
GVSVLTSKVLDLKNYIDKQLLPIVNKQSSISNIE

SEQ ID NO: 1394 - protein, 34 aa, Artificial Sequence
  Core polypeptide
VSVLTSKVLDLKNYIDKQLLPIVNKQSSISNIET

SEQ ID NO: 1395 - protein, 34 aa, Artificial Sequence
  Core polypeptide
SVLTSKVLDLKNYIDKQLLPIVNKQSSISNIETV

SEQ ID NO: 1396 - protein, 34 aa, Artificial Sequence
  Core polypeptide
VLTSKVLDLKNYIDKQLLPIVNKQSSISNIETVI

SEQ ID NO: 1397 - protein, 33 aa, Artificial Sequence
  Core polypeptide
LTSKVLDKNYIDKQLLPIVNKQSSISNIETVIE

SEQ ID NO: 1398 - protein, 34 aa, Artificial Sequence
  Core polypeptide
TSKVLDLKNYIDKQLLPIVNKQSSISNIETVIEF

SEQ ID NO: 1399 - protein, 34 aa, Artificial Sequence
  Core polypeptide
SKVLDLKNYIDKQLLPIVNKQSSISNIETVIEFQ

SEQ ID NO: 1400 - protein, 34 aa, Artificial Sequence
  Core polypeptide
KVLDLKNYIDKQLLPIVNKQSSISNIETVIEFQQ

SEQ ID NO: 1401 - protein, 34 aa, Artificial Sequence
  Core polypeptide
VLDLKNYIDKQLLPIVNKQSSISNIETVIEFQQK

SEQ ID NO: 1402 - protein, 34 aa, Artificial Sequence
  Core polypeptide
LDLKNYIDKQLLPIVNKQSSISNIETVIEFQQKN

SEQ ID NO: 1403 - protein, 34 aa, Artificial Sequence
  Core polypeptide
DLKNYIDKQLLPIVNKQSSISNIETVIEFQQKNN

SEQ ID NO: 1404 - protein, 34 aa, Artificial Sequence
  Core polypeptide
LKNYIDKQLLPIVNKQSSISNIETVIEFQQKNNR

SEQ ID NO: 1405 - protein, 34 aa, Artificial Sequence
  Core polypeptide
KNYIDKQLLPIVNKQSSISNIETVIEFQQKNNRL

SEQ ID NO: 1406 - protein, 35 aa, Artificial Sequence
  Core polypeptide
NYIDKQLLPIVNKQSISISNIETVIEFQQKNNRLL

SEQ ID NO: 1407 - protein, 34 aa, Artificial Sequence
  Core polypeptide
YIDKQLLPIVNKQSSISNIETVIEFQQKNNRLLE

SEQ ID NO: 1408 - protein, 34 aa, Artificial Sequence
  Core polypeptide
IDKQLLPIVNKQSSISNIETVIEFQQKNNRLLEI

SEQ ID NO: 1409 - protein, 34 aa, Artificial Sequence
  Core polypeptide
DKQLLPIVNKQSSISNIETVIEFQQKNNRLLEIT

SEQ ID NO: 1410 - protein, 34 aa, Artificial Sequence
  Core polypeptide
KQLLPIVNKQSSISNIETVIEFQQKNNRLLEITR

SEQ ID NO: 1411 - protein, 34 aa, Artificial Sequence
  Core polypeptide
QLLPIVNKQSSISNIETVIEFQQKNNRLLEITRE

SEQ ID NO: 1412 - protein, 23 aa, Artificial Sequence
  Core polypeptide
VYPSDEYDASISQVNEEINQALA

SEQ ID NO: 1413 - protein, 23 aa, Artificial Sequence
  Core polypeptide
QVNEEINQALAYIRKADELLENV

SEQ ID NO: 1414 - protein, 35 aa, Artificial Sequence; identical to SEQ ID NO: 692
  Core polypeptide

SEQ ID NO: 1415 - protein, 27 aa, Artificial Sequence
  Core polypeptide
DEYDASISQVNEEINQALAYIREADEL

SEQ ID NO: 1416 - protein, 27 aa, Artificial Sequence
  Core polypeptide
DEYDASISQVNEKINQALAYIREADEL

SEQ ID NO: 1417 - protein, 35 aa, Artificial Sequence; identical to SEQ ID NO: 1240
  Core polypeptide

SEQ ID NO: 1418 - protein, 34 aa, Artificial Sequence
  Core polypeptide
DDELNSVKNGTYDFPKFEEESKLNRNEIKGVKLS

SEQ ID NO: 1419 - protein, 39 aa, Artificial Sequence
  Core polypeptide
YHKCDDECLNSVKNGTFDFPKFEEESKLNREIKGVKLSS

SEQ ID NO: 1420 - protein, 38 aa, Artificial Sequence
  Core polypeptide
YHKDDELNSVKNGTFDFPKFEEESKLNRNEIKGVKLSS

SEQ ID NO: 1421 - protein, 36 aa, Artificial Sequence; identical to SEQ ID NO: 1246
  Core polypeptide

SEQ ID NO: 1422 - protein, 36 aa, Artificial Sequence; identical to SEQ ID NO: 1247
  Core polypeptide

SEQ ID NO: 1423 - protein, 36 aa, Artificial Sequence; identical to SEQ ID NO: 1248
  Core polypeptide

SEQ ID NO: 1424 - protein, 36 aa, Artificial Sequence; identical to SEQ ID NO: 1249
  Core polypeptide

SEQ ID NO: 1425 - protein, 36 aa, Artificial Sequence; identical to SEQ ID NO: 1250
  Core polypeptide

SEQ ID NO: 1426 - protein, 36 aa, Artificial Sequence; identical to SEQ ID NO: 1251
  Core polypeptide

SEQ ID NO: 1427 - protein, 35 aa, Artificial Sequence
  Core polypeptide
YTSLIHSLIEESQIQQEKNEYELQKLDWASLWEWF

SEQ ID NO: 1428 - protein, 36 aa, Artificial Sequence; identical to SEQ ID NO: 1253
  Core polypeptide

SEQ ID NO: 1429 - protein, 36 aa, Artificial Sequence; identical to SEQ ID NO: 1254
  Core polypeptide

SEQ ID NO: 1430 - protein, 36 aa, Artificial Sequence; identical to SEQ ID NO: 1255
  Core polypeptide

SEQ ID NO: 1431 - protein, 35 aa, Artificial Sequence
  Core polypeptide
WQEWEQKITALLEQAQIQQEKNEYELQKLDKWEWF

SEQ ID NO: 1432 - protein, 39 aa, Artificial Sequence
  Core polypeptide
WQEWEQKITALLEQAQIQQEKNEYELQKLIEWASLWEWF

SEQ ID NO: 1433 - protein, 8 aa, Artificial Sequence
  Core polypeptide
WASLWEWF

SEQ ID NO: 1434 - protein, 35 aa, Artificial Sequence; identical to SEQ ID NO: 1122
  Core polypeptide

SEQ ID NO: 1435 - protein, 35 aa, Artificial Sequence; identical to SEQ ID NO: 1123
  Core polypeptide

SEQ ID NO: 1436 - protein, 31 aa, Artificial Sequence
  Core polypeptide
WQAWDEYDASISDVNEKINQALAYIREADEL

SEQ ID NO: 1437 - skipped

SEQ ID NO: 1438 - protein, 40 aa, Artificial sequence
  Core polypeptide
GWQEWEQRITALLEQAQIQQERNEYELQRLDEWASLWEWF

SEQ ID NO: 1439 - protein, 40 aa, Artificial sequence; identical to SEQ ID NO: 1438
  Core polypeptide

SEQ ID NO: 1440 - protein, 36 aa, Artificial sequence
  Core polypeptide
YTSLITALLEQAQIQQERNEQELLELDEWASLWEWF

SEQ ID NO: 1441 - protein, 36 aa, Artificial sequence; identical to SEQ ID NO: 1440
  Core polypeptide

SEQ ID NO: 1442 - protein, 40 aa, Artificial sequence
  Core polypeptide
GWQEWEQRITALLEQAQIQQERNEYELQELDEWASLWEWF

SEQ ID NO: 1443 - protein, 40 aa, Artificial sequence; identical to SEQ ID NO: 1442
  Core polypeptide

SEQ ID NO: 1444 - protein, 36 aa, Artificial sequence; identical to SEQ ID NO: 1223
  Core polypeptide

SEQ ID NO: 1445 - protein, 40 aa, Artificial sequence
  Core polypeptide
GWQEWEQRITALLEQAQIQQERNEYELQRLDRWASLWEWF

SEQ ID NO: 1446 - protein, 40 aa, Artificial sequence; identical to SEQ ID NO: 1445
  Core polypeptide

SEQ ID NO: 1447 - protein, 40 aa, Artificial sequence
  Core polypeptide
GWQEWEQRITALLEQAQIQQERNEYELQELDRWASLWEWF

SEQ ID NO: 1448 - protein, 40 aa, Artificial sequence; identical to SEQ ID NO: 1447
  Core polypeptide

SEQ ID NO: 1449 - protein, 36 aa, Artificial sequence
  Core polypeptide
YTSLIGSLIEESQNQQERNEQELLELDRWASLWNWF

SEQ ID NO: 1450 - protein, 36 aa, Artificial sequence; identical to SEQ ID NO: 1449
  Core polypeptide

SEQ ID NO: 1451 - protein, 18 aa, Artificial sequence
  Core polypeptide
YTSLIHSLIEESQNQQEK

SEQ ID NO: 1452 - protein, 18 aa, Artificial sequence
  Core polypeptide
NEQELLELDKWASLWNWF

SEQ ID NO: 1453 - protein, 39 aa, Artificial sequence
  Core polypeptide
AAAWEQKITALLEQAQIQQEKNEYELQKLDKWASLWEWF

SEQ ID NO: 1454 - protein, 39 aa, Artificial sequence
  Core polypeptide
WQEAAAKITALLEQAQIQQEKNEYELQKLDKWASLWEWF

SEQ ID NO: 1455 - protein, 39 aa, Artificial sequence
  Core polypeptide
WQEWEQAAAALLEQAQIQQEKNEYELQKLDKWASLWEWF

SEQ ID NO: 1456 - protein, 39 aa, Artificial sequence
  Core polypeptide
WQEWEQKITAAAEQAQIQQEKNEYELQKLDKWASLWEWF

SEQ ID NO: 1457 - protein, 39 aa, Artificial sequence
  Core polypeptide
WQEWEQKITALLAAAQIQQEKNEYELQKLDKWASLWEWF

SEQ ID NO: 1458 - protein, 39 aa, Artificial sequence
  Core polypeptide
WQEWEQKITALLEQAAAAQEKNEYELQKLDKWASLWEWF

SEQ ID NO: 1459 - protein, 39 aa, Artificial sequence
  Core polypeptide
WQEWEQKITALLEQAQIQAAANEYELQKLDKWASLWEWF

SEQ ID NO: 1460 - protein, 39 aa, Artificial sequence
  Core polypeptide
WQEWEQKITALLEQAQIQQEKAAAELQKLDKWASLWEWF

SEQ ID NO: 1461 - protein, 39 aa, Artificial sequence
  Core polypeptide
WQEWEQKITALLEQAQIQQEKNEYAAAKLDKWASLWEWF

SEQ ID NO: 1462 - protein, 39 aa, Artificial sequence
  Core polypeptide
WQEWEQKITALLEQAQIQQEKNEYELQAAAKWASLWEWF

SEQ ID NO: 1463 - protein, 39 aa, Artificial sequence
  Core polypeptide
WQEWEQKITALLEQAQIQQEKNEYELQKLDAAASLWEWF

SEQ ID NO: 1464 - protein, 39 aa, Artificial sequence
  Core polypeptide
WQEWEQKITALLEQAQIQQEKNEYELQKLDKWAAAAEWF

SEQ ID NO: 1465 - protein, 39 aa, Artificial sequence
  Core polypeptide
WQEWEQKITALLEQAQIQQEKNEYELQKLDKWASLWAAA

SEQ ID NO: 1466 - protein, 35 aa, Artificial sequence
  Core polypeptide
YTSLIHSLIEESQNQQEKNEQELLLDKWASLWNWF

SEQ ID NO: 1467 - protein, 35 aa, Artificial sequence
  Core polypeptide
YTSLIHSLIEESQNQEKNEQELLELDKWASLWNWF

SEQ ID NO: 1468 - protein, 9 aa, Artificial sequence
  Core polypeptide
ERTLDFHDS

SEQ ID NO: 1469 - protein, 36 aa, Artificial sequence; identical to SEQ ID NO: 15
  Core polypeptide

SEQ ID NO: 1470 - protein, 36 aa, Artificial sequence; identical to SEQ ID NO: 15
  Core polypeptide

SEQ ID NO: 1471 - protein, 26 aa, Artificial sequence
  Core polypeptide
YTSLIHSLIEESQNQQDKWASLWNWF

SEQ ID NO: 1472 - protein, 35 aa, Artificial sequence
  Core polypeptide
FYEIIMDIEQNNVQGKKGIQQLQKWEDWVGWIGNI

SEQ ID NO: 1473 - protein, 35 aa, Artificial sequence
  Core polypeptide
INQTIWNHGNITLGEWYNQTKDLQQKFYEIIMDIE

SEQ ID NO: 1474 - protein, 35 aa, Artificial sequence
  Core polypeptide
WNHGNITLGEWYNQTKDLQQKFYEIIMDIEQNNVQ

SEQ ID NO: 1475 - protein, 36 aa, Artificial sequence
  Core polypeptide
YTSLIHSLIEESENQQEKNEQELLELDKWASLWNWF

SEQ ID NO: 1476 - protein, 36 aa, Artificial sequence; identical to SEQ ID NO: 729
  Core polypeptide

SEQ ID NO: 1477 - protein, 36 aa, Artificial sequence
  Core polypeptide
YTSLIHSLIEESQNEQEKNEQELLELDKWASLWNWF

SEQ ID NO: 1478 - protein, 36 aa, Artificial sequence
  Core polypeptide
YTSLIHSLIEESQNQEEKNEQELLELDKWASLWNWF

SEQ ID NO: 1479 - protein, 36 aa, Artificial sequence; identical to SEQ ID NO: 728
  Core polypeptide

SEQ ID NO: 1480 - protein, 35 aa, Artificial sequence
  Core polypeptide
LGEWYNQTKDLQQKFYEIIMDIEQNNVQGKKGIQQ

SEQ ID NO: 1481 - protein, 35 aa, Artificial sequence
  Core polypeptide
WYNQTKDLQQKFYEIIMDIEQNNVQGKKGIQQLQK

SEQ ID NO: 1482 - protein, 36 aa, Artificial sequence
  Core polypeptide
YTSLIHSLIEESQNQQEKNEEELLELDKWASLWNWF

SEQ ID NO: 1483 - protein, 36 aa, Artificial sequence; identical to SEQ ID NO: 731
  Core polypeptide

SEQ ID NO: 1484 - protein, 36 aa, Artificial sequence
  Core polypeptide
  SITE (1)...(1): Xaa=unknown amino acid
  SITE (36)...(36): Xaa=unknown amino acid
XTSLIHSLIEESQNQQEKNEQELLELDKWASLWNWX

SEQ ID NO: 1485 - protein, 35 aa, Artificial sequence
  Core polypeptide
YNQTKDLQQKFYEIIMDIEQNNVQGKKGIQQLQKW

SEQ ID NO: 1486 - protein, 36 aa, Artificial sequence; identical to SEQ ID NO: 15
  Core polypeptide

SEQ ID NO: 1487 - protein, 44 aa, Artificial sequence
  Core polypeptide
TLTVQARQLLSGIVQQQNNLLRAIEAQQHLLQLTVWGIKQLQAR

SEQ ID NO: 1488 - protein, 35 aa, Artificial sequence
  Core polypeptide
LQQKFYEIIMDIEQNNVQGKKGIQQLQKWEDWVGW

SEQ ID NO: 1489 - protein, 36 aa, Artificial sequence
  Core polypeptide
YTSLIHSLIEESQNQQEKNEQELLALDKWASLWNWF

SEQ ID NO: 1490 - protein, 36 aa, Artificial sequence
  Core polypeptide
YTSLIHSLIEESQNQQEKNEQELLEADKWASLWNWF

SEQ ID NO: 1491 - protein, 36 aa, Artificial sequence
  Core polypeptide
YTSLIHSLIEESQNQQEKNEQELLELAKWASLWNWF

SEQ ID NO: 1492 - protein, 36 aa, Artificial sequence
  Core polypeptide
YTSLIHSLIEESQNQQEKAEQELLELDKWASLWNWF

SEQ ID NO: 1493 - protein, 36 aa, Artificial sequence
  Core polypeptide
YTSLIHSLIEESQNQQEKNAQELLELDKWASLWNWF

SEQ ID NO: 1494 - protein, 36 aa, Artificial sequence
  Core polypeptide
YTSLIHSLIEESQNQQEKNEAELLELDKWASLWNWF

SEQ ID NO: 1495 - protein, 39 aa, Artificial sequence
  Core polypeptide
WQEWEQKITALLEQAQIQQEKNEQELQKLDKWASLWEWF

SEQ ID NO: 1496 - protein, 39 aa, Artificial sequence
  Core polypeptide
WQEWEQKITALLEQAQIQQEKAEYELQKLDKWASLWEWF

SEQ ID NO: 1497 - protein, 39 aa, Artificial sequence
  Core polypeptide
WQEWEQKITALLEQAQIQQEKNAYELQKLDKWASLWEWF

SEQ ID NO: 1498 - protein, 39 aa, Artificial sequence
  Core polypeptide
WQEWEQKITALLEQAQIQQEKNEAELQKLDKWASLWEWF

SEQ ID NO: 1499 - protein, 9 aa, Artificial sequence
  Core polypeptide
EYDLRRWEK

SEQ ID NO: 1500 - protein, 9 aa, Artificial sequence
  Core polypeptide
EQELLELDK

SEQ ID NO: 1501 - protein, 9 aa, Artificial sequence
  Core polypeptide
EYELQKLDK

SEQ ID NO: 1502 - protein, 39 aa, Artificial sequence
  Core polypeptide
WQEWEQKITALLEQAQIQQEKNEQELLKLDKWASLWEWF

SEQ ID NO: 1503 - protein, 39 aa, Artificial sequence
  Core polypeptide
WQEWEQKITALLEQAQIQQEKNEQELLELDKWASLWEWF

SEQ ID NO: 1504 - protein, 32 aa, Artificial sequence
  Core polypeptide
WQEWEQKITALLEQAQIQQEKNDKWASLWEWF

SEQ ID NO: 1505 - protein, 36 aa, Artificial sequence
  Core polypeptide
YTSLIHSLIEESQNQAEKNEQELLELDKWASLWNWF

SEQ ID NO: 1506 - protein, 36 aa, Artificial sequence
  Core polypeptide
YTSLIHSLIEESQNQQAKNEQELLELDKWASLWNWF

SEQ ID NO: 1507 - protein, 36 aa, Artificial sequence
  Core polypeptide
YTSLIHSLIEESQNQQEANEQELLELDKWASLWNWF

SEQ ID NO: 1508 - protein, 36 aa, Artificial sequence
  Core polypeptide
YTSLIHSLIEESANQQEANEQELLELDKWASLWNWF

SEQ ID NO: 1509 - protein, 38 aa, Artificial sequence
  Core polypeptide
YTSLIHSLIEESQAQQEKNEQELLELDKWASLWNWFNH

SEQ ID NO: 1510 - protein, 36 aa, Artificial sequence
  Core polypeptide
YTSLIHSLIEESQNAQEKNEQELLELDKWASLWNWF

SEQ ID NO: 1511 - protein, 36 aa, Artificial sequence
  Core polypeptide
YTSLIHALIEESQNQQEKNEQELLELDKWASLWNWF

SEQ ID NO: 1512 - protein, 36 aa, Artificial sequence
  Core polypeptide
YTSLIHSAIEESQNQQEKNEQELLELDKWASLWNWF

SEQ ID NO: 1513 - protein, 35 aa, Artificial sequence; identical to SEQ ID NO: 692
  Core polypeptide

SEQ ID NO: 1514 - protein, 36 aa, Artificial sequence
  Core polypeptide
YTSLIHSLAEESQNQQEKNEQELLELDKWASLWNWF

SEQ ID NO: 1515 - protein, 36 aa, Artificial sequence
  Core polypeptide
YTSAIHSLIEESQNQQEKNEQELLELDKWASLWNWF

SEQ ID NO: 1516 - protein, 36 aa, Artificial sequence
  Core polypeptide
YTSLAHSLIEESQNQQEKNEQELLELDKWASLWNWF

SEQ ID NO: 1517 - protein, 36 aa, Artificial sequence
  Core polypeptide
YTSLIASLIEESQNQQEKNEQELLELDKWASLWNWF

SEQ ID NO: 1518 - protein, 36 aa, Artificial sequence
  Core polypeptide
ATSLIHSLIEESQNQQEKNEQELLELDKWASLWNWF

SEQ ID NO: 1519 - protein, 36 aa, Artificial sequence
  Core polypeptide
YASLIHSLIEESQNQQEKNEQELLELDKWASLWNWF

SEQ ID NO: 1520 - protein, 36 aa, Artificial sequence
  Core polypeptide
YTALIHSLIEESQNQQEKNEQELLELDKWASLWNWF

SEQ ID NO: 1521 - protein, 30 aa, Artificial sequence
  Core polypeptide
RIQDLEKYVEDTKIDLWSYNAELLVALENQ

SEQ ID NO: 1522 - protein, 24 aa, Artificial sequence
  Core polypeptide
HTIDLTDSEMNKLFEKTRRQLREN

SEQ ID NO: 1523 - protein, 17 aa, Artificial sequence
  Core polypeptide
SEMNKLFEKTRRQLREN

SEQ ID NO: 1524 - protein, 35 aa, Artificial sequence
  Core polypeptide
VFPSDEADASISQVNEKINQSLAFIRKSDELLHNV

SEQ ID NO: 1525 - protein, 35 aa, Artificial sequence
  Core polypeptide
VFPSDEFAASISQVNEKINQSLAFIRKSDELLHNV

SEQ ID NO: 1526 - protein, 35 aa, Artificial sequence
  Core polypeptide
VFPSDEFDASISAVNEKINQSLAFIRKSDELLHNV

SEQ ID NO: 1527 - protein, 35 aa, Artificial sequence
  Core polypeptide
VFPSDEFDASISQANEKINQSLAFIRKSDELLHNV

SEQ ID NO: 1528 - protein, 35 aa, Artificial sequence
  Core polypeptide
VFPSDEFDASISQVAEKINQSLAFIRKSDELLHNV

SEQ ID NO: 1529 - protein, 39 aa, Artificial sequence
  Core polypeptide
WQEWEQKITAALEQAQIQQEKNEYELQKLDKWASLWEWF

SEQ ID NO: 1530 - protein, 39 aa, Artificial sequence
  Core polypeptide
WQEWEQKITALAEQAQIQQEKNEYELQKLDKWASLWEWF

SEQ ID NO: 1531 - protein, 39 aa, Artificial sequence
  Core polypeptide
WQEWEQKITALLEQAAIQQEKNEYELQKLDKWASLWEWF

SEQ ID NO: 1532 - protein, 39 aa, Artificial sequence
  Core polypeptide
WQEWEQKITALLEQAQAQQEKNEYELQKLDKWASLWEWF

SEQ ID NO: 1533 - protein, 39 aa, Artificial sequence
  Core polypeptide
WQEWEQKITALLEQAQIAQEKNEYELQKLDKWASLWEWF

SEQ ID NO: 1534 - protein, 39 aa, Artificial sequence
  Core polypeptide
WQEWEQKITALLEQAQIQAEKNEYELQKLDKWASLWEWF

SEQ ID NO: 1535 - protein, 35 aa, Artificial sequence
  Core polypeptide
VFPSDEFDASISQVNEKINQSAAFIRKSDELLHNV

SEQ ID NO: 1536 - protein, 35 aa, Artificial sequence
  Core polypeptide
VFPSDEFDASISQVNEKINQSLAAIRKSDELLHNV

SEQ ID NO: 1537 - protein, 35 aa, Artificial sequence
  Core polypeptide
VFPSDEFDASISQVNEKINQSLAFIRKSDEALHNV

SEQ ID NO: 1538 - protein, 35 aa, Artificial sequence
  Core polypeptide
VFPSDEFDASISQVNEKINQSLAFIRKSDELAHNV

SEQ ID NO: 1539 - protein, 35 aa, Artificial sequence
  Core polypeptide
VFPSDEFDASISQVNEKINQSLAFIRKSDELLANV

SEQ ID NO: 1540 - protein, 39 aa, Artificial sequence
  Core polypeptide
WQEWEQKITALLEQAQIQQAKNEYELQKLDKWASLWEWF

SEQ ID NO: 1541 - protein, 39 aa, Artificial sequence
  Core polypeptide
WQEWEQKITALLEQAQIQQEKNEYELQALDKWASLWEWF

SEQ ID NO: 1542 - protein, 39 aa, Artificial sequence
  Core polypeptide
WQEWEQKITALLEQAQIQQEKNEYELQKADKWASLWEWF

SEQ ID NO: 1543 - protein, 8 aa, Artificial Sequence
  Core polypeptide
IERDWEMW

SEQ ID NO: 1544 - protein, 8 aa, Artificial Sequence
  Core polypeptide
WMEWDREI

SEQ ID NO: 1545 - protein, 8 aa, Artificial Sequence
  Core polypeptide
WQEWERKV

SEQ ID NO: 1546 - protein, 8 aa, Artificial Sequence
  Core polypeptide
WQEWEQKV

SEQ ID NO: 1547 - protein, 10 aa, Artificial Sequence
  Core polypeptide
MTWMEWDREI

SEQ ID NO: 1548 - protein, 12 aa, Artificial Sequence
  Core polypeptide
NNMTWMEWDREI

SEQ ID NO: 1549 - protein, 15 aa, Artificial Sequence
  Core polypeptide
WQEWEQKVRYLEANI

SEQ ID NO: 1550 - protein, 19 aa, Artificial Sequence
  Core polypeptide
NNMTWQEWEZKVRYLEANI

SEQ ID NO: 1551 - protein, 5 aa, Artificial Sequence
  Core polypeptide
WNWFI

SEQ ID NO: 1552 - protein, 15 aa, Artificial Sequence
  Core polypeptide
WQEWDREISNYTSLI

SEQ ID NO: 1553 - protein, 15 aa, Artificial Sequence
  Core polypeptide
WQEWEREISAYTSLI

SEQ ID NO: 1554 - protein, 8 aa, Artificial Sequence
  Core polypeptide
WQEWDREI

SEQ ID NO: 1555 - protein, 6 aa, Artificial Sequence
  Core polypeptide
WQEWEI

SEQ ID NO: 1556 - protein, 4 aa, Artificial Sequence
  Core polypeptide
WNWF

SEQ ID NO: 1557 - protein, 4 aa, Artificial Sequence
  Core polypeptide
WQEW

SEQ ID NO: 1558 - protein, 4 aa, Artificial Sequence
  Core polypeptide
WQAW

SEQ ID NO: 1559 - protein, 8 aa, Artificial Sequence
  Core polypeptide
WQEWEQKI

SEQ ID NO: 1560 - protein, 8 aa, Artificial Sequence
  Core polypeptide
WASLWNWF

SEQ ID NO: 1561 - protein, 8 aa, Artificial Sequence
  Core polypeptide
WASLFNFF

SEQ ID NO: 1562 - protein, 8 aa, Artificial Sequence
  Core polypeptide
WDVFTNWL

SEQ ID NO: 1563 - protein, 8 aa, Artificial Sequence
  Core polypeptide
WASLWEWF

SEQ ID NO: 1564 - protein, 9 aa, Artificial Sequence
  Core polypeptide
EWASLWEWF

SEQ ID NO: 1565 - protein, 4 aa, Artificial Sequence
  Core polypeptide
WEWF

SEQ ID NO: 1566 - protein, 5 aa, Artificial Sequence
  Core polypeptide
EWEWF

SEQ ID NO: 1567 - protein, 6 aa, Artificial Sequence
  Core polypeptide
IEWEWF

SEQ ID NO: 1568 - protein, 5 aa, Artificial Sequence
  Core polypeptide
IEWEW

SEQ ID NO: 1569 - protein, 4 aa, Artificial Sequence
  Core polypeptide
EWEW

SEQ ID NO: 1570 - protein, 8 aa, Artificial Sequence
  Core polypeptide
WASLWEWF

SEQ ID NO: 1571 - protein, 8 aa, Artificial Sequence
  Core polypeptide
WAGLWEWF

SEQ ID NO: 1572 - protein, 10 aa, Artificial Sequence
  Core polypeptide
AKWASLWEWF

SEQ ID NO: 1573 - protein, 10 aa, Artificial Sequence
  Core polypeptide
AEWASLWEWF

SEQ ID NO: 1574 - protein, 8 aa, Artificial Sequence
  Core polypeptide
WASLWAWF

SEQ ID NO: 1575 - protein, 10 aa, Artificial Sequence
  Core polypeptide
AEWASLWAWF

SEQ ID NO: 1576 - protein, 10 aa, Artificial Sequence
  Core polypeptide
AKWASLWAWF

SEQ ID NO: 1577 - protein, 8 aa, Artificial Sequence
  Core polypeptide
WAGLWAWF

SEQ ID NO: 1578 - protein, 10 aa, Artificial Sequence
  Core polypeptide
AEWAGLWAWF

SEQ ID NO: 1579 - protein, 7 aa, Artificial Sequence
  Core polypeptide
WASLWAW

SEQ ID NO: 1580 - protein, 9 aa, Artificial Sequence
  Core polypeptide
AEWASLWAW

SEQ ID NO: 1581 - protein, 7 aa, Artificial Sequence
  Core polypeptide
WAGLWAW

SEQ ID NO: 1582 - protein, 9 aa, Artificial Sequence
  Core polypeptide
AEWAGLWAW

SEQ ID NO: 1583 - protein, 6 aa, Artificial Sequence
  Core polypeptide
DKWEWF

SEQ ID NO: 1584 - protein, 10 aa, Artificial Sequence
  Core polypeptide
IEWASLWEWF

SEQ ID NO: 1585 - protein, 10 aa, Artificial Sequence
  Core polypeptide
IKWASLWEWF

SEQ ID NO: 1586 - protein, 6 aa, Artificial Sequence
  Core polypeptide
DEWEWF

SEQ ID NO: 1587 - protein, 10 aa, Artificial Sequence
  Core polypeptide
GGWASLWNWF

SEQ ID NO: 1588 - protein, 6 aa, Artificial Sequence
  Core polypeptide
GGWNWF

SEQ ID NO: 1589 - protein, 34 aa, Artificial Sequence
  Core polypeptide
WMEWDREINKYTSLIHSLIEESQNQQEKNEQELL

SEQ ID NO: 1590 - protein, 8 aa, SIV
WQEWEQKI

SEQ ID NO: 1591 - protein, 8 aa, SIV
WLEWERQI

SEQ ID NO: 1592 - protein, 8 aa, SIV
WLEWEKQI

SEQ ID NO: 1593 - protein, 8 aa, HIV-2
WQQWEQQI

SEQ ID NO: 1594 - protein, 8 aa, HIV-2
WQQWEKQI

SEQ ID NO: 1595 - protein, 8 aa, HIV-2
WQEWEHKI

SEQ ID NO: 1596 - protein, 8 aa, HIV-2
WQEWEGKI

SEQ ID NO: 1597 - protein, 8 aa, HIV-2
WQEWEQQI

SEQ ID NO: 1598 - protein, 8 aa, HIV-2
WQKWEQQI

SEQ ID NO: 1599 - protein, 8 aa, HIV-2
WQEWEQRI

SEQ ID NO: 1600 - protein, 8 aa, HIV-1
WLQWDKEI

SEQ ID NO: 1601 - protein, 8 aa, HIV-1
WMDWEREI

SEQ ID NO: 1602 - protein, 8 aa, HIV-1
WMEWEKEI

SEQ ID NO: 1603 - protein, 8 aa, HIV-1
WMEWDREI

SEQ ID NO: 1604 - protein, 8 aa, HIV-1
WMEWEREI

SEQ ID NO: 1605 - protein, 8 aa, HIV-1
WIEWEREI

SEQ ID NO: 1606 - protein, 8 aa, HIV-1
WIEWDREI

SEQ ID NO: 1607 - protein, 8 aa, HIV-1
WMQWDREI

SEQ ID NO: 1608 - protein, 8 aa, HIV-1
WIQWEREI

SEQ ID NO: 1609 - protein, 8 aa, HIV-1
WGIWRWGI

SEQ ID NO: 1610 - protein, 8 aa, HIV-1
WIQWDREI

SEQ ID NO: 1611 - protein, 8 aa, HIV-1
WIQWEKEI

SEQ ID NO: 1612 - protein, 8 aa, HIV-1
WMQWEKEI

SEQ ID NO: 1613 - protein, 8 aa, HIV-1
WQQWDQHI

SEQ ID NO: 1614 - protein, 8 aa, HIV-1
WMQWEREI

SEQ ID NO: 1615 - protein, 8 aa, HIV-1
WQEWDRQI

SEQ ID NO: 1616 - protein, 8 aa, HIV-1
WQQWDQQI

SEQ ID NO: 1617 - protein, 8 aa, HIV-1
WIEWKREI

SEQ ID NO: 1618 - protein, 8 aa, HIV-1
WMEWEMEI

SEQ ID NO: 1619 - protein, 8 aa, HIV-1
WIEWEKEI

SEQ ID NO: 1620 - protein, 8 aa, HIV-1
WMQWKREI

SEQ ID NO: 1621 - protein, 8 aa, HIV-1
WMEWNREI

SEQ ID NO: 1622 - protein, 8 aa, HIV-1
WREWDREI

SEQ ID NO: 1623 - protein, 8 aa, HIV-1
WTEWEREI

SEQ ID NO: 1624 - protein, 8 aa, HIV-1
WLEWEREI

SEQ ID NO: 1625 - protein, 8 aa, HIV-1
WMGWEREI

SEQ ID NO: 1626 - protein, 8 aa, HIV-1
WQEWDQQI

SEQ ID NO: 1627 - protein, 8 aa, HIV-1
WMKWEREI

SEQ ID NO: 1628 - protein, 8 aa, HIV-1
  SITE (1)...(8): Xaa=unknown amino acid
WXXWXXXI

SEQ ID NO: 1629 - protein, 8 aa, SIV
WAGLWEWF

SEQ ID NO: 1630 - protein, 8 aa, SIV
WSNFWSWF

SEQ ID NO: 1631 - protein, 8 aa, SIV
WDSLWSWF

SEQ ID NO: 1632 - protein, 8 aa, SIV
WSGFWSWF

SEQ ID NO: 1633 - protein, 8 aa, SIV
WSSLWNWF

SEQ ID NO: 1634 - protein, 8 aa, SIV
WSDFWSWF

SEQ ID NO: 1635 - protein, 8 aa, SIV
WSDIWSWV

SEQ ID NO: 1636 - protein, 8 aa, SIV
WASLWNWF

SEQ ID NO: 1637 - protein, 8 aa, SIV
WSSFWSWF

SEQ ID NO: 1638 - protein, 8 aa, HIV-2
WDVFGNWF

SEQ ID NO: 1639 - protein, 8 aa, HIV-2
WDVFTNWL

SEQ ID NO: 1640 - protein, 8 aa, HIV-2
WDIFGNWF

SEQ ID NO: 1641 - protein, 8 aa, HIV-2
WDVFGNWL

SEQ ID NO: 1642 - protein, 8 aa, HIV-2
WDIFGNWS

SEQ ID NO: 1643 - protein, 8 aa, HIV-2
WDVFSNWF

SEQ ID NO: 1644 - protein, 8 aa, HIV-2
WDILGNWF

SEQ ID NO: 1645 - protein, 8 aa, HIV-1
WANLWNWF

SEQ ID NO: 1646 - protein, 8 aa, HIV-1
WASLWNWF

SEQ ID NO: 1647 - protein, 8 aa, HIV-1
WENLWNWF

SEQ ID NO: 1648 - protein, 8 aa, HIV-1
WASLWNWV

SEQ ID NO: 1649 - protein, 8 aa, HIV-1
WENLWSWF

SEQ ID NO: 1650 - protein, 8 aa, HIV-1
WDSLWGWF

SEQ ID NO: 1651 - protein, 8 aa, HIV-1
WDSLWNWF

SEQ ID NO: 1652 - protein, 8 aa, HIV-1
WASLWTWF

SEQ ID NO: 1653 - protein, 8 aa, HIV-1
WKNLWNWF

SEQ ID NO: 1654 - protein, 8 aa, HIV-1
WTSLWSWF

SEQ ID NO: 1655 - protein, 8 aa, HIV-1
WASIWNWL

SEQ ID NO: 1656 - protein, 8 aa, HIV-1
WQNLWNWF

SEQ ID NO: 1657 - protein, 8 aa, HIV-1
WQNLWSWF

SEQ ID NO: 1658 - protein, 8 aa, HIV-1
WPNLWNWF

SEQ ID NO: 1659 - protein, 8 aa, HIV-1
WASLWSWF

SEQ ID NO: 1660 - protein, 8 aa, HIV-1
WSSLWNWF

SEQ ID NO: 1661 - protein, 8 aa, HIV-1
WGSLWSWF

SEQ ID NO: 1662 - protein, 8 aa, HIV-1
WANLWSWF

SEQ ID NO: 1663 - protein, 8 aa, HIV-1
WAGLWNWF

SEQ ID NO: 1664 - protein, 8 aa, HIV-1
WTNLWNWF

SEQ ID NO: 1665 - protein, 8 aa, HIV-1
WPSLWNWF

SEQ ID NO: 1666 - protein, 8 aa, HIV-1
WAGLWSWF

SEQ ID NO: 1667 - protein, 8 aa, HIV-1
WASLWTWS

SEQ ID NO: 1668 - protein, 8 aa, HIV-1
  SITE (1)...(8): Xaa=unknown amino acid
WXXXWXWX

SEQ ID NO: 1669 - protein, 6 aa, Artificial Sequence
  Core polypeptide
ETVQQQ

SEQ ID NO: 1670 - protein, 34 aa, Artificial Sequence
  Core polypeptide
  SITE 17: Xaa = U (Aminobutyric Acid)
YTSVITIELSNIKENKXNGTDAVKLIKQELDKYK

SEQ ID NO: 1671 - protein, 34 aa, Artificial Sequence
  Core polypeptide
  SITE 16: Xaa = U (Aminobutyric Acid)
TSVITIELSNIKENKXNGTDAVKLIKQELDKYKN

SEQ ID NO: 1672 - protein, 34 aa, Artificial Sequence
  Core polypeptide
  SITE 15: Xaa = U (Aminobutyric Acid)
SVITIELSNIKENKXNGTDAVKLIKQELDKYKNA

SEQ ID NO: 1673 - protein, 35 aa, Artificial Sequence
  Core polypeptide
  SITE 8: Xaa = U (Aminobutyric Acid)
SNIKENKXNGTDAKVKLIKQELDKYKNAVTELQLL

SEQ ID NO: 1674 - protein, 35 aa, Artificial Sequence
  Core polypeptide
  SITE 5: Xaa = U (Aminobutyric Acid)
KENKXNGTDAKVKLIKQELDKYKNAVTELQLLMQS

SEQ ID NO: 1675 - protein, 35 aa, Artificial Sequence
  Core polypeptide
PPLVLQAGFFLLTRILTIPQSLDSWWTSLNFLGGT

SEQ ID NO: 1676 - protein, 36 aa, Artificial Sequence
  Core polypeptide
  SITE 31: Xaa = U (Aminobutyric Acid)
AVSKGYLSALRTGWYTSVITIELSNIKENKXNGTDA

SEQ ID NO: 1677 - protein, 35 aa, Artificial Sequence
  Core polypeptide
  SITE 33: Xaa = U (Aminobutyric Acid)
RAKFKQLLQHYREVAAAKSSENDRLRLLLKQMXPS

SEQ ID NO: 1678 - protein, 35 aa, Artificial Sequence
  Core polypeptide
  SITE 1, 5: Xaa = Abu (Aminobytyric acid)
XDDEXMNSVKNGTYDYPKYEEESKLNRNEIKGVKL

SEQ ID NO: 1679 - protein, 38 aa, Artificial Sequence
  Core polypeptide
  SITE 2: Xaa = Nle (Norleucine)
MXWMEWDREINNYTSLIHSLIEESQNQQEKNEQELLEL

SEQ ID NO: 1680 - protein, 36 aa, Artificial Sequence
  Core polypeptide
  SITE 2: Xaa = Nle (Norleucine)
WXEWDREINNYTSLIHSLIEESQNQQEKNEQELLEL

SEQ ID NO: 1681 - protein, 10 aa, Artificial Sequence
  Core polypeptide
  SITE 1, 2: Xaa = Aca (aminocaprioc acid)
XXIRKSDELL

SEQ ID NO: 1682 - protein, 36 aa, Artificial Sequence; identical to SEQ ID NO: 1680
  Core polypeptide
  SITE 2: Xaa = Nle (Norleucine)

SEQ ID NO: 1683 - protein, 35 aa, Artificial Sequence
  Core polypeptide
IDISIELNKAKSDLEEAKEWIDDANQKLDSIGNWH

SEQ ID NO: 1684 - protein, 25 aa, Artificial Sequence
  Core polypeptide
YDASISQVNEEINQALAFIRKADEL

SEQ ID NO: 1685 - protein, 26 aa, Artificial Sequence
  Core polypeptide
YDASISQVNEEINQSLAYIRKADELL

SEQ ID NO: 1686 - protein, 35 aa, Artificial Sequence
  Core polypeptide
IDISIELNKAKSDLEESKEWIEKSNQKLDSIGNWH

SEQ ID NO: 1687 - protein, 35 aa, Artificial Sequence
  Core polypeptide
VYPSDEYDASISQVNEKINQSLAYIRKSDELLHNV

SEQ ID NO: 1688 - protein, 35 aa, Artificial Sequence
  Core polypeptide
QWFVFLSPTVWLSVIWMMWYWGPSLYSILSPFLPL

SEQ ID NO: 1689 - protein, 28 aa, Artificial Sequence
  Core polypeptide
  SITE 16: Xaa = Abu (aminobutyric acid)
PTRVNYILIIGVLVLXEVTGVRADVHLL

SEQ ID NO: 1690 - protein, 35 aa, Artificial Sequence
  Core polypeptide
  SITE 16: Xaa = Abu (aminobutyric acid)
PTRVNYILIIGVLVLXEVTGVRADVHLLEQPGNLW

SEQ ID NO: 1691 - protein, 35 aa, Artificial Sequence
  Core polypeptide
  SITE 23: Xaa = Abu (aminobutyric acid)
PEKTPLLPTRVNYILIIGVLVLXEVTGVRADVHLL

SEQ ID NO: 1692 - protein, 39 aa, Artificial Sequence
  Core polypeptide
  SITE 1: Xaa = Aha
XGGGVYPSDEYDASISQVNEEINQALAYIRKADELLENV

SEQ ID NO: 1693 - protein, 11 aa, Artificial Sequence
  Core polypeptide
HWSYALALRPG

SEQ ID NO: 1694 - protein, 35 aa, Artificial Sequence
  Core polypeptide
  SITE 1, 2, 3, 32, 33, 34: Xaa = Aca (aminocaproic acid)
XXXDEFDESISQVNEKIEESLAFIRKSDELLXXXW

SEQ ID NO: 1695 - protein, 37 aa, Artificial Sequence
  Core polypeptide
  SITE 1, 2, 3, 34, 35, 36: Xaa = Aca (aminocaproic acid)
XXXGDEFDESISQVNEKIEESLAFIRKSDELLGXXXW

SEQ ID NO: 1696 - protein, 35 aa, Artificial Sequence
  Core polypeptide
  SITE 2: Xaa = Nal (napthylalanine)
VXPSDEYDASISQVNEEINQALAYIRKADELLENV

SEQ ID NO: 1697 - protein, 35 aa, Artificial Sequence
  Core polypeptide
  SITE 2, 7: Xaa = Nal (napthylalanine)
VXPSDEXDASISQVNEEINQALAYIRKADELLENV

SEQ ID NO: 1698 - protein, 35 aa, Artificial Sequence
  Core polypeptide
  SITE 2, 24: Xaa = Nal (napthylalanine)
VXPSDEYDASISQVNEEINQALAXIRKADELLENV

SEQ ID NO: 1699 - protein, 36 aa, Artificial Sequence; identical to SEQ ID NO: 1025
  Core polypeptide

SEQ ID NO: 1700 - protein, 28 aa, Artificial Sequence
  Core polypeptide
  SITE 1, 2, 3, 25, 26, 27: Xaa = Aua (11-aminoundecanoic acid)
XXXTALLEQAQIQQEKNEYELQKLXXXW

SEQ ID NO: 1701 - protein, 36 aa, Artificial Sequence
  Core polypeptide
WQAAEQKVRYLEANITALLEQAQIQQEKNEYELQKL

SEQ ID NO: 1702 - protein, 36 aa, Artificial Sequence
  Core polypeptide
WQEWEAAVRYLEANITALLEQAQIQQEKNEYELQKL

SEQ ID NO: 1703 - protein, 36 aa, Artificial Sequence
  Core polypeptide
WQEWEQAARYLEANITALLEQAQIQQEKNEYELQKL

SEQ ID NO: 1704 - protein, 36 aa, Artificial Sequence; identical to SEQ ID NO: 1033
  Core polypeptide

SEQ ID NO: 1705 - protein, 36 aa, Artificial Sequence; identical to SEQ ID NO: 1034
  Core polypeptide

SEQ ID NO: 1706 - protein, 47 aa, Artificial Sequence
  Core polypeptide
WQEWEQKVRYLEANITALLEQAQIQQEKNEYELQKLGGGGWASLWNF

SEQ ID NO: 1707 - protein, 39 aa, Artificial Sequence
  Core polypeptide
  SITE 6, 35: Xaa = Aca (aminocaproic acid)
GWNWFXDEFDESISQVQEEIEESLAFIEESDELLXWNWF

SEQ ID NO: 1708 - protein, 38 aa, Artificial Sequence
  Core polypeptide
  SITE 5, 34: Xaa = Aca (aminocaproic acid)
WNWFXDEFDESISQVNEKIEESLAFIRKSDELLXWNWF

SEQ ID NO: 1709 - protein, 38 aa, Artificial Sequence
  Core polypeptide
  SITE 5, 34: Xaa = Aca (aminocaproic acid)
WNWFXDEFDESISQVNEKIEESLAFIEESDELLXWNWF

SEQ ID NO: 1710 - protein, 35 aa, Artificial Sequence; identical to SEQ ID NO: 1099
  Core polypeptide

SEQ ID NO: 1711 - protein, 35 aa, Artificial Sequence; identical to SEQ ID NO: 1156
  Core polypeptide

SEQ ID NO: 1712 - protein, 35 aa, Artificial Sequence
  Core polypeptide
  SITE 11: Xaa = U (Aminobutyric Acid)
LSTTQWQVLPXSFTTLPALSTGLIHLHQNIVDVQY

SEQ ID NO: 1713 - protein, 33 aa, Artificial Sequence
  Core polypeptide
  SITE 12, 22: Xaa = U (Aminobutyric Acid)
FRKFPEATFSRXGSGPRITPRXMVDFPFRLWHY

SEQ ID NO: 1714 - protein, 39 aa, Artificial Sequence
  Core polypeptide
  SITE 11, 35: Xaa = U (Aminobutyric Acid)
DFPFRLWHFPXTINYTIFKVRLFVGGVEHRLEAAXNWTR

SEQ ID NO: 1715 - protein, 34 aa, Artificial Sequence
  Core polypeptide
  SITE 13, 21: Xaa = U (Aminobutyric Acid)
YVGGVEHRLEAAXNWTRGERXDLEDRDRSELSPL

SEQ ID NO: 1716 - protein, 27 aa, Artificial Sequence
  Core polypeptide
  SITE 3, 17, 24: Xaa = Any Amino Acid
YTXLIHSLIWESQNQQXKNEQELXELD

SEQ ID NO: 1717 - protein, 39 aa, Artificial Sequence
  Core polypeptide
  SITE 6, 13, 20, 27: Xaa = Any Amino Acid
WQEQEXKITALLXQAQIQQXKNEYELXKLDKWASLWEWF

SEQ ID NO: 1718 - protein, 30 aa, Artificial Sequence
  Core polypeptide
  SITE 6, 13, 20, 27: Xaa = Any Amino Acid
WQEWWXKITALLXQAQIQQXKNEYELXKLD

SEQ ID NO: 1719 - protein, 27 aa, Artificial Sequence
  Core polypeptide
  SITE 3, 10, 17, 24: Xaa = Any Amino Acid
WEXKITALLXQAQIQQXKNEYELXKLD

SEQ ID NO: 1720 - protein, 35 aa, Artificial Sequence
  Core polypeptide
STNKAVVSLSNGVSVGTSKVLDLKNYIDKQLLPIV

SEQ ID NO: 1721 - protein, 35 aa, Artificial Sequence
  Core polypeptide
  SITE 35: Xaa = U (Aminobutyric Acid)
VVSLSNGVSVLTSKVDLKNYIDKQWLLPIVNKQSX

SEQ ID NO: 1722 - protein, 35 aa, Artificial Sequence
  Core polypeptide
  SITE 34: Xaa = U (Aminobutyric Acid)
VSLSNGVSVLTSKVLDLKNYIDKQLLPIVNKQSXS

SEQ ID NO: 1723 - protein, 35 aa, Artificial Sequence
  Core polypeptide
  SITE 33: Xaa = U (Aminobutyric Acid)
SLSNGVSVLTSKVLDLKNYIDKQLLPIVNKQSXSI

SEQ ID NO: 1724 - protein, 35 aa, Artificial Sequence
  Core polypeptide
  SITE 32: Xaa = U (Aminobutyric Acid)
LSNGVSVLTSKVLDLKNYIDKQLLPIVNKQSXSIS

SEQ ID NO: 1725 - protein, 35 aa, Artificial Sequence
  Core polypeptide
  SITE 31: Xaa = U (Aminobutyric Acid)
SNGVSVLTSKVLDLKNYIDKQLLPIVNKQSXSISN

SEQ ID NO: 1726 - protein, 35 aa, Artificial Sequence
  Core polypeptide
  SITE 30: Xaa = U (Aminobutyric Acid)
NGVSVLTSKVLDLKNYIDKQLLPIVNKQSXSISNI

SEQ ID NO: 1727 - protein, 35 aa, Artificial Sequence
  Core polypeptide
  SITE 29: Xaa = U (Aminobutyric Acid)
GVSVLTSKVLDLKNYIDKQLLPIVNKQSXSISNIE

SEQ ID NO: 1728 - protein, 36 aa, Artificial Sequence
  Core polypeptide
  SITE 28: Xaa = U (Aminobutyric Acid)
VSVLTSKVLDLKNYIDKQLLPIVNKQSXSISINIET

SEQ ID NO: 1729 - protein, 35 aa, Artificial Sequence
  Core polypeptide
  SITE 27: Xaa = U (Aminobutyric Acid)
SVLTSKVLDLKNYIDKQLLPIVNKQSXSISNIETV

SEQ ID NO: 1730 - protein, 35 aa, Artificial Sequence
  Core polypeptide
  SITE 26: Xaa = U (Aminobutyric Acid)
VLTSKVLDLKNYIDKQLLPIVNKQSXSISNIETVI

SEQ ID NO: 1731 - protein, 35 aa, Artificial Sequence
  Core polypeptide
  SITE 25: Xaa = U (Aminobutyric Acid)
LTSKVLDLKNYIDKQLLPIVNKQSXSISNIETVIE

SEQ ID NO: 1732 - protein, 35 aa, Artificial Sequence
  Core polypeptide
  SITE 24: Xaa = U (Aminobutyric Acid)
TSKVLDLKNYIDKQLLPIVNKQSXSISNIETVIEF

SEQ ID NO: 1733 - protein, 35 aa, Artificial Sequence
  Core polypeptide
  SITE 23: Xaa = U (Aminobutyric Acid)
SKVLDLKNYIDKQLLPIVNKQSXSISNIETVIEFQ

SEQ ID NO: 1734 - protein, 35 aa, Artificial Sequence
  Core polypeptide
  SITE 22: Xaa = U (Aminobutyric Acid)
KVLDLKNYIDKQLLPIVNKQSXSISNIETVIEFQQ

SEQ ID NO: 1735 - protein, 35 aa, Artificial Sequence
  Core polypeptide
  SITE 21: Xaa = U (Aminobutyric Acid)
VLDLKNYIDKQLLPIVNKQSXSISNIETVIEFQQK

SEQ ID NO: 1736 - protein, 35 aa, Artificial Sequence
  Core polypeptide
  SITE 20: Xaa = U (Aminobutyric Acid)
LDLKNYIDKQLLPIVNKQSXSISNIETVIEFQQKN

SEQ ID NO: 1737 - protein, 35 aa, Artificial Sequence
  Core polypeptide
  SITE 19: Xaa = U (Aminobutyric Acid)
DLKNYIDKQLLPIVNKQSXSISNIETVIEFQQKNN

SEQ ID NO: 1738 - protein, 35 aa, Artificial Sequence
  Core polypeptide
  SITE 18: Xaa = U (Aminobutyric Acid)
LKNYIDKQLLPIVNKQSXSISNIETVIEFQQKNNR

SEQ ID NO: 1739 - protein, 35 aa, Artificial Sequence
  Core polypeptide
  SITE 17: Xaa = U (Aminobutyric Acid)
KNYIDKQLLPIVNKQSXSISNIETVIEFQQKNNRL

SEQ ID NO: 1740 - protein, 35 aa, Artificial Sequence
  Core polypeptide
  SITE 16: Xaa = U (Aminobutyric Acid)
NYIDKQLLPIVNKQSXSISNIETVIEFQQKNNRLL

SEQ ID NO: 1741 - protein, 35 aa, Artificial Sequence
  Core polypeptide
  SITE 15: Xaa = U (Aminobutyric Acid)
YIDKQLLPIVNKQSXSISNIETVIEFQQKNNRLLE

SEQ ID NO: 1742 - protein, 35 aa, Artificial Sequence
  Core polypeptide
  SITE 14: Xaa = U (Aminobutyric Acid)
IDKQLLPIVNKQSXSISNIETVIEFQQKNNRLLEI

SEQ ID NO: 1743 - protein, 35 aa, Artificial Sequence
  Core polypeptide
  SITE 13: Xaa = U (Aminobutyric Acid)
DKQLLPIVNKQSXSISNIETVIEFQQKNNRLLEIT

SEQ ID NO: 1744 - protein, 35 aa, Artificial Sequence
  Core polypeptide
  SITE 12: Xaa = U (Aminobutyric Acid)
KQLLPIVNKQSXSISNIETVIEFQQKNNRLLEITR

SEQ ID NO: 1745 - protein, 35 aa, Artificial Sequence
  Core polypeptide
  SITE 11: Xaa = U (Aminobutyric Acid)
QLLPIVNKQSXSISNIETVIEFQQKNNRLLEITRE

SEQ ID NO: 1746 - protein, 35 aa, Artificial Sequence
  Core polypeptide
  SITE 4: Xaa = Abu (aminobutyric acid)
DDEXLNSVKNGTYDFPKFEEESKLNRNEIKGVKLS

SEQ ID NO: 1747 - protein, 40 aa, Artificial Sequence; identical to SEQ ID NO: 1242
  Core polypeptide

SEQ ID NO: 1748 - protein, 40 aa, Artificial Sequence
  Core polypeptide
  SITE 4, 8: Xaa = Abu (aminobutyric acid)
YHKXDDEXLNSVKNGTFDFPKFEEESKLNRNEIKGVKLSS

SEQ ID NO: 1749 - protein, 36 aa, Artificial Sequence
  Core polypeptide
YTSLIHSLIEESQIQQEKNEQELLELDKWASLWNWF

SEQ ID NO: 1750 - protein, 36 aa, Artificial Sequence
  Core polypeptide
YTSLIHSLIEESQNQQEKNEYELLELDKWASLWNWF

SEQ ID NO: 1751 - protein, 36 aa, Artificial Sequence
  Core polypeptide
YTSLIHSLIEESQIQQEKNEYELLELDKWASLWNWF

SEQ ID NO: 1752 - protein, 36 aa, Artificial Sequence; identical to SEQ ID NO: 1252
  Core polypeptide

SEQ ID NO: 1753 - protein, 35 aa, Artificial Sequence
  Core polypeptide
WQEWEQKITALLEQAQIQQEKNEYELQKLDKEWWF

SEQ ID NO: 1754 - protein, 35 aa, Artificial Sequence
  Core polypeptide
WQEWEQKITALLEQAQIQQEKGEYELQKLDWQWEF

SEQ ID NO: 1755 - protein, 35 aa, Artificial Sequence
  Core polypeptide
WEQWEQKITALLEQAQIQQEKNEYELLELDKWEWF

SEQ ID NO: 1756 - protein, 40 aa, Artificial Sequence
  Core polypeptide
WQEWEQKITALLEQAQIQQEKNEYELEEELIEWASLWEWF

SEQ ID NO: 1757 - protein, 30 aa, Artificial Sequence
  Core polypeptide
WQEWQAQIQQEKNEYELQKLDKWASLWEWF

What is claimed is:

1. A hybrid polypeptide comprising a core polypeptide linked to an enhancer peptide, wherein the core polypeptide comprises the following amino acid sequence:

YTSLIHSLIEESQNQQEKNEQELLELDK;
LEENITALLEEAQIQQEKNMYELQKLNS;
LEANISQSLEQAQIQQEKNMYELQKLNS;
NNYTSLIHSLIEESQNQQEKNEQELLEL;
DFLEENITALLEEAQIQQEKNMYELQKL;
RYLEANISQSLEQAQIQQEKNMYELQKL;
RYLEANITALLEQAQIQQEKNEYELQKL;
NNYTSLIHSLIEESQNQQEKNEQELLELDK;
TALLEQAQIQQEKNEYELQKLDE;
TALLEQAQIQQEKNEYELQKLIE;
TALLEQAQIQQEKIEYELQKLDK;
TALLEQAQIQQEKIEYELQKLDE;
TALLEQAQIQQEKIEYELQKLIE;
TALLEQAQIQQEKIEYELQKLE;
TALLEQAQIQQEKIEYELQKLAK;
TALLEQAQIQQEKIEYELQKLAE;
TALLEQAQIQQEKAEYELQKLE;
TALLEQAQIQQEKNEYELQKLE;
TALLEQAQIQQEKGEYELQKLE;

TALLEQAQIQQEKAEYELQKLAK;
TALLEQAQIQQEKNEYELQKLAK;
TALLEQAQIQQEKGEYELQKLAK;
TALLEQAQIQQEKAEYELQKLAE;
TALLEQAQIQQEKNEYELQKLAE;
TALLEQAQIQQEKGEYELQKLAE;
DEFDASISQVNEKINQSLAFIRKSDELL;
DEYDASISQVNEKINQALAYIREADEL;
DEYDASISQVNEEINQALAYIRKADEL;
DEFDESISQVNEKIEESLAFIRKSDELL;
DEFDESISQVNEKIEESLAFIRKSDEL; or
QHWSYGLRPG (SEQ ID NOS:1278–1285 and 1287–1309, respectively);
wherein the enhancer peptide sequence comprises WQEWEQKI (SEQ ID NO:1129) or WASLWEWF (SEQ ID NO:1433).

2. The hybrid polypeptide of claim 1, wherein the enhancer peptide sequence is linked to the amino-terminal end of the core polypeptide.

3. The hybrid polypeptide of claim 2, further comprising an enhancer peptide sequence linked to the carboxy-terminal end of the core polypeptide.

4. The hybrid polypeptide of claim 1, wherein the enhancer peptide sequence is linked to the carboxy-terminal end of the core polypeptide.

5. A polypeptide comprising the amino acid sequence:
VYPSDEYDASISQVNEEINQALAYIRKADELLENV (SEQ ID NO:692).

6. The polypeptide of claim 5, further comprising an amino-terminal acetyl group and a carboxy-terminal amido group.

7. A core polypeptide comprising:

| | |
|---|---|
| RYLEANISQSLEQAQIQQEKNMYELQKL | (SEQ ID NO:1283); |
| RYLEANITALLEQAQIQQEKNEYELQKL | (SEQ ID NO:1284); |
| TALLEQAQIQQEKNEYELQKLDE | (SEQ ID NO:1287); |
| TALLEQAQIQQEKNEYELQKLIE | (SEQ ID NO:1288); |
| TALLEQAQIQQEKIEYELQKLDK | (SEQ ID NO:1289); |
| TALLEQAQIQQEKIEYELQKLDE | (SEQ ID NO:1290); |
| TALLEQAQIQQEKIEYELQKLIE | (SEQ ID NO:1291); |
| TALLEQAQIQQEKIEYELQKLE | (SEQ ID NO:1292); |
| TALLEQAQIQQEKIEYELQKLAK | (SEQ ID NO:1293); |
| TALLEQAQIQQEKIEYELQKLAE | (SEQ ID NO:1294); |
| TALLEQAQIQQEKAEYELQKLE | (SEQ ID NO:1295); |
| TALLEQAQIQQEKNEYELQKLE | (SEQ ID NO:1296); |
| TALLEQAQIQQEKGEYELQKLE | (SEQ ID NO:1297); |
| TALLEQAQIQQEKAEYELQKLAK | (SEQ ID NO:1298); |
| TALLEQAQIQQEKNEYELQKLAK | (SEQ ID NO:1299); |
| TALLEQAQIQQEKGEYELQKLAK | (SEQ ID NO:1300); |
| TALLEQAQIQQEKAEYELQKLAE | (SEQ ID NO:1301); |
| TALLEQAQIQQEKNEYELQKLAE | (SEQ ID NO:1302); |
| TALLEQAQIQQEKGEYELQKLAE | (SEQ ID NO:1303); |
| DEYDASISQVNEKINQALAYIREADEL | (SEQ ID NO:1304); |
| DEYDASISQVNEEINQALAYIRKADEL | (SEQ ID NO:1306); |
| DEFDESISQVNEKIEESLAFIRKSDELL | (SEQ ID NO:1307); or |
| DEFDESISQVNEKIEESLAFIRKSDEL | (SEQ ID NO:1308). |

8. A method for enhancing the pharmacokinetic properties of a core polypeptide comprising linking an enhancer peptide sequence to a core polypeptide, wherein the enhancer peptide comprises an amino-terminal or carboxy-terminal sequence WXXWXXXI or IXXXWXXW, to form a hybrid polypeptide, such that, when introduced into a living system, the hybrid polypeptide exhibits enhanced pharmacokinetic properties relative to those exhibited by the core polypeptide.

9. A method for enhancing the pharmacokinetic properties of a core polypeptide comprising linking an enhancer peptide to a heteropolymeric core polypeptide, wherein the enhancer peptide comprises an amino-terminal or carboxy-terminal sequence WXXWXXXI, IXXXWXXW, WXXWXXX, WXXXWXwx, XXXWXWX, XXWXWX, XWXWX, WXWX, WXXXWXW, WXXXWX, WXXXW, XXXWXXW, XWXWXXXW, XWXWXXX, XWXWXX, XWXW, WXWXXXW, or XWXXXW, and wherein the heteropolymeric core polypeptide comprises at least about 94 amino acid residues, to form a hybrid polypeptide such that, when introduced into a living system, the hybrid polypeptide exhibits enhanced pharmacokinetic properties relative to those exhibited by the heteropolymeric core polypeptide.

10. A hybrid polypeptide comprising an enhancer peptide linked to a core polypeptide, wherein the enhancer peptide comprises an amino-terminal or carboxy-terminal sequence WXXWXXXI or IXXXWXXW.

11. A hybrid polypeptide comprising an enhancer peptide linked to a heteropolymeric core polypeptide, wherein the enhancer peptide comprises an amino-terminal or carboxy-terminal sequence WXXWXXXI, IXXXWXXW, WXXWXXX, WXXXWXWX, XXXWXWX, XXWXWX, XWXWX, WXWX, WXXXWXW, WXXXWX, WXXXW, XXXWXXW, XWXWXXXW, XWXWXXX, XWXWXX, XWXW, WXWXXXW, or XWXXXW, and wherein the heteropolymeric core polypeptide comprises at least about 94 amino acid residues.

12. A hybrid polypeptide comprising an enhancer peptide linked to a core polypeptide, wherein the core polypeptide sequence comprises the following amino acid sequence:
RYLEANISQSLEQAQIQQEKNMYELQKL;
RYLEANITALLEQAQIQQEKNEYELQKL;
TALLEQAQIQQEKNEYELQKLDE;
TALLEQAQIQQEKNEYELQKLIE;
TALLEQAQIQQEKIEYELQKLDK;
TALLEQAQIQQEKIEYELQKLDE;
TALLEQAQIQQEKIEYELQKLIE;
TALLEQAQIQQEKIEYELQKLE;
TALLEQAQIQQEKIEYELQKLAK;
TALLEQAQIQQEKIEYELQKLAE;
TALLEQAQIQQEKAEYELQKLE;
TALLEQAQIQQEKNEYELQKLE;
TALLEQAQIQQEKGEYELQKLE;
TALLEQAQIQQEKAEYELQKLAK;
TALLEQAQIQQEKNEYELQKLAK;
TALLEQAQIQQEKGEYELQKLAK;
TALLEQAQIQQEKAEYELQKLAE;
TALLEQAQIQQEKNEYELQKLAE;
TALLEQAQIQQEKGEYELQKLAE;
DEYDASISQVNEKINQALAYIREADEL;
DEYDASISQVNEEINQALAYIRKADEL;
DEFDESISQVNEKIEESLAFIRKSDELL; or
DEFDESISQVNEKIEESLAFIRKSDEL (SEQ ID NOS:1283–1284, 1287–1303, 1305–1308, respectively).

13. The hybrid polypeptide of claim 12, wherein the enhancer peptide is linked to the amino-terminal end of the core polypeptide.

14. The hybrid polypeptide of claim 13, further comprising an enhancer peptide linked to the carboxy-tenninal end of the core polypeptide.

15. The hybrid polypeptide of claim 12, wherein the enhancer peptide is linked to the carboxy-terminal end of the core polypeptide.

16. A hybrid polypeptide comprising an enhancer peptide linked to the carboxy terminus of a core polypeptide, wherein the core polypeptide comprises the sequence YTSLIHSLIEESQNQQEKNEQELLELDK (SEQ ID NO:1278), and wherein the enhancer peptide comprises a carboxy-terminal sequence WXXWXXXI, IXXXWXXW, WXXWXXX, WXXWXX, WXXWX, WXXW, XXXWXWX, XXWXWX, XWXWX, WXWX, XXXWXXW, XXWXXW, XWXXW, XWXWXXXW, XWXWXXX, XWXWXX, XWXW, WXWXXXW, or XWXXXW.

17. A hybrid polypeptide comprising an enhancer peptide linked to a core polypeptide, wherein the core polypeptide comprises the sequence

NNYTSLIHSLIEESQNQQEKNEQELLEL (SEQ ID NO:1281);

DEFDASISQVNEKINQSLAFIRKSDELL (SEQ ID NO:1304); or

QHWSYGLRPG (SEQ ID NO:1309); and wherein the enhancer peptide is 4 to about 30 amino acids in length, and comprises an amino-terminal or carboxy-terminal sequence WXXWXXXI, IXXXWXXW, WXXWXXX, WXXWXX, WXXWX, WXXW, WXXXWXWX, XXXWXWX, XXWXWX, XWXWX, WXWX, WXXXWXW, XXXWXXW, XXWXXW, XWXXW, XWXWXXXW, XWXWXXX, XWXWXX, XWXW, WXWXXXW, or XWXXXW.

18. A method for enhancing the pharmacokinetic properties of a core polypeptide, comprising linking an enhancer peptide sequence to the core polypeptide to produce a hybrid polypeptide, wherein the enhancer peptide sequence comprises WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises TALLEQAQIQQEKNEYELQKLDK (SEQ ID NO:1286), and wherein at least one amino acid residue of the hybrid polypeptide is polyol-conjugated such that, when introduced into a living system, the hybrid polypeptide exhibits enhanced pharmacokinetic properties relative to those exhibited by the core polypeptide.

19. A hybrid polypeptide comprising an enhancer peptide sequence linked to a core polypeptide, wherein the enhancer peptide sequence comprises an amino-terminal WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises TALLEQAQIQQEKNEYELQKLDK (SEQ ID NO:1286), and wherein at least one amino acid residue of the hybrid polypeptide is polyol-conjugated.

20. The hybrid polypeptide of claim 19, further comprising an enhancer peptide sequence linked to the carboxy-terminal end of the core polypeptide.

21. A hybrid polypeptide comprising an enhancer peptide sequence linked to a core polypeptide, wherein the enhancer peptide sequence comprises WQEWEQKI (SEQ ID NO:1129) or WASLWEWF (SEQ ID NO:1433); wherein the core polypeptide comprises TALLEQAQIQQEKNEYELQKLDK (SEQ ID NO:1286), and wherein at least one amino acid residue of the hybrid polypeptide is polyol-conjugated.

22. A polypeptide comprising the amino acid sequence WQEWEQKITALLEQAQIQQEKNEYELQKLDKWASLWEWF (SEQ ID NO:1310), wherein at least one amino acid residue of the polypeptide is polyol-conjugated.

23. A hybrid polypeptide comprising an enhancer peptide sequence linked to a core polypeptide, wherein the enhancer peptide sequence comprises a carboxy-terminal WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises TALLEQAQIQQEKNEYELQKLDK (SEQ ID NO:1286), and wherein at least one amino acid residue of the hybrid polypeptide is polyol-conjugated.

24. The hybrid polypeptide of claim 23, further comprising an enhancer peptide sequence linked to the amino-terminal end of the core polypeptide.

25. A polypeptide comprising TALLEQAQIQQEKNEYELQKLDK (SEQ ID NO:1286), wherein at least one amino acid residue of the polypeptide is polyol-conjugated.

26. A pharmaceutical composition comprising the polypeptide TALLEQAQIQQEKNEYELQKLDK (SEQ ID NO:1286), wherein at least one amino acid residue of the polypeptide is polyol-conjugated, and a pharmaceutically acceptable carrier.

27. A pharmaceutical composition comprising the polypeptide WQEWEQKITALLEQAQIQQEKNEYELQKLDKWASLWEWF (SEQ ID NO:1310), wherein at least one amino acid residue of the polypeptide is polyol-conjugated, and a pharmaceutically acceptable carrier.

28. A hybrid polypeptide comprising an enhancer peptide sequence linked to a core polypeptide, wherein the enhancer peptide sequence comprises WQEWEQKI (SEQ ID NO:1129) or WASLWEWF (SEQ ID NO:1433); and wherein at least one amino acid residue of the hybrid polypeptide is polyol-conjugated.

29. The hybrid polypeptide of claim 28, wherein the enhancer peptide sequence is linked to the amino terminus of the core polypeptide.

30. The hybrid polypeptide of claim 29, further comprising an enhancer peptide sequence linked to the carboxy terminus of the core polypeptide.

31. The hybrid polypeptide of claim 28, wherein the enhancer peptide sequence is linked to the carboxy terminus of the core polypeptide.

32. The hybrid polypeptide of claim 28, wherein the enhancer peptide sequence comprises WQEWEQKI (SEQ ID NO:1129).

33. The hybrid polypeptide of claim 28, wherein the enhancer peptide sequence comprises WASLWEWF (SEQ ID NO:1433).

34. A hybrid polypeptide comprising an enhancer peptide sequence linked to a core polypeptide, wherein the enhancer peptide sequence comprises an amino-terminal WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises the following amino acid sequence: LEENITALLEEAQIQQEKNMYELQKLNS; LEANISQSLEQA- QIQQEKNMYELQKLNS; DFLEENITALLEEA-
QIQQEKNMYELQKL; RYLEANISQSLEQAQIQ
QEKNMYELQKL; RYLEANITALLEQAQIQQ
EKNEYELQKL; NNYTSLIHSLIEESQNQQEKNEQEL-
LELDK; TALLEQAQIQQEKNEYELQKLDE; TALL-
EQAQIQQEKNEYELQKLIE; TALLEQAQIQQEK-
IEYELQKLDK; TALLEQAQIQQEKIEYELQKLDE;
TALLEQAQIQQEKIEYELQKLIE; TALLEQAQIQQEK-
IEYELQKLE; TALLEQAQIQQEKIEYELQKLAK, TALL-
EQAQIQQEKIEYELQKLAE; TALLEQAQIQQE-
KAEYELQKLE; TALLEQAQIQQEKNEYELQKLE;
TALLEQAQIQQEKGEYELQKLE; TALLEQAQIQQE-
KAEYELQKLAK; TALLEQAQIQQEKNEYELQKLAK;
TALLEQAQIQQEKGEYELQKLAK; TALLEQAQIQQE-
KAEYELQKLAE; TALLEQAQIQQEKNEYELQKLAE;
TALLEQAQIQQEKGEYELQKLAE; DEFDA-
SISQVNEKINQSKAFIRKSDELL; DEYDA-
SISQVNEKINQALAYIREADEL; DEYDASISQVNEEIN-
QALAYIRKADEL; DEFDESISQVNEKIEESLAF
IRKSDELL; DEFDESISQVNEKIESSKLAFIRKSDEL; or
QHWYSYGLRPG (SEQ ID NOS:1279, 1280, 1282–1285,
and 1287–1309, respectively); and wherein at least one
amino acid residue of the hybrid polypeptide is polyol-
conjugated.

35. The hybrid polypeptide of claim 34, further comprising an enhancer peptide sequence linked to the carboxy-terminal end of the core polypeptide.

36. A hybrid polypeptide comprising an enhancer peptide sequence linked to a core polypeptide, wherein the enhancer peptide sequence comprises WQEWEQKI (SEQ ID NO:1129) or WASLWEWF (SEQ ID NO:1433); wherein the core polypeptide comprises the following amino acid sequence YTSLIHSLIEESQNQQEKNEQELLELDK; LEENITALLEEAQIQQEKNMYELQKLNS; LEANISQSLEQAQIQQEKNMYELQKLNS; NYTSLIH-SLIEESQNQQEKNEQELLEL; DFLEENITALLEEA-QIQQEKNMYELQKL; RYLEANISQSLEQAQIQQE KNMYELQKL; RYLEANITALLEQAQIQQEKNEYE LQKL; NNYTSLIHSLIEESQNQQEKNEQELLELDK; TALLEQAQIQQEKNEYELQKLDE; TALLEQA-QIQQEKNEYELQKLIE; TALLEQAQIQQEK-IEYELQKLDK; TALLEQAQIQQEKIEYELQKLDE; TALLEQAQIQQEKIEYELQKLIE; TALLEQAQIQQEK-IEYELQKLE; TALLEQAQIQQEKIEYELQKLAK; TALLEQAQIQQEKIEYELQKLAE; TALLEQAQIQQE-KAEYELQKLE; TALLEQAQIQQEKNEYELQKLE; TALLEQAQIQQEKGEYELQKLE; TALLEQAQIQQE-KAEYELQKLAK; TALLEQAQIQQEKNEYELQKLAK; TALLEQAQIQQEKGEYELQKLAK; TALLEQAQIQQE-KAEYELQKLAE; TALLEQAQIQQEKNEYELQKLAE; TALLEQAQIQQEKGEYELQKLAE; DEFDA-SISQVNEKINQSLAFIRKSDELL; DEYDA-SISQVNEKINQALAYIREADEL; DEYDASISQVNEEINQA-LAYIRKADEL; DEFDESISQVNEKIEESL AFIRDSDELL; DEFDESISQVNEKIEESLAFIRDSDEL; or QHWSYGLRPG (SEQ ID NOS:1278–1285 and 1287–1309, respectively); and wherein at least one amino acid residue of the hybrid polypeptide is polyol-conjugated.

37. The hybrid polypeptide of claim 36, wherein the enhancer peptide sequence is linked to the amino-terminal end of the core polypeptide.

38. The hybrid polypeptide of claim 37, further comprising an enhancer peptide sequence linked to the carboxy-terminal end of the core polypeptide.

39. The hybrid polypeptide of claim 36, wherein the enhancer peptide sequence is linked to the carboxy-terminal end of the core polypeptide.

40. The hybrid polypeptide of claim 36, wherein the hybrid polypeptide comprises the amino acid sequence WQEWEQKITALLEQAQIQQEKIEYELQKLIEWEWF (SEQ ID NO:1311).

41. A hybrid polypeptide comprising an enhancer peptide sequence linked to a core polypeptide, wherein the enhancer peptide sequence comprises a carboxy-terminal WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises the following amino acid sequence LEENI-TALLEEAQIQQEKNMYELQKLNS; LEANISQSLEQA-QIQQEKNMYELQKLNS: DFLEENITALLEEA-QIQQEKNMYELQKL; RYLEANISQSLEQAQIQ QEKNMYELQKL; RYLEANITALLEQAQIQQE KNEYELQKL; TALLEQAQIQQEKNEYELQKLDE; TALLEQAQIQQEKNEYELQKLIE; TALLEQAQIQQEK-IEYELQKLDK; TALLEQAQIQQEKIEYELQKLDE; TALLEQAQIQQEKIEYELQKLIE; TALLEQAQIQQEK-IEYELQKLE; TALLEQAQIQQEKIEYELQKLAK; TALLEQAQIQQEKIEYELQKLAE; TALLEQAQIQQE-KAEYELQKLE; TALLEQAQIQQEKNEYELQKLE; TALLEQAQIQQEKGEYELQKLE; TALLEQAQIQQE-KAEYELQKLAK; TALLEQAQIQQEKNEYELQKLAK; TALLEQAQIQQEKGEYELQKLAK; TALLEQAQIQQE-KAEYELQKLAE; TALLEQAQIQQEKNEYELQKLAE; TALLEQAQIQQEKGEYELQKLAE; DEFDA-SISQVNEKINQSLAFIRKSDELL; DEYDADIS-QVNEKINQALAYIREADEL; DEYDASISQVNEEINQA-LAYIRKADEL; DEFDESISQVNEKIEESLAFI RKSDELL; DEFDESISQVNEKIEESLAFIRKSDEL; or QHWSYGLRPG (SEQ ID NOS:1279, 1280, 1282–1284, and 1287–1309, respectively); and wherein at least one amino acid residue of the hybrid polypeptide is polyol-conjugated.

42. The hybrid polypeptide of claim 41, further comprising an enhancer peptide sequence linked to the amino-terminal end of the core polypeptide.

43. A hybrid polypeptide comprising an enhancer peptide sequence linked to a core polypeptide, wherein the enhancer peptide sequence is linked to the amino-terminal end of the core polypeptide and comprises an amino-terminal WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises NNYTSLIHSLIEESQNQQEKNEQELLEL (SEQ ID NO:1281), and wherein at least one amino acid residue of the hybrid polypeptide is polyol-conjugated.

44. The hybrid polypeptide of claim 43, further comprising an enhancer peptide sequence linked to the carboxy-terminal end of the core polypeptide.

45. A hybrid polypeptide comprising an enhancer-peptide sequence linked to a core polypeptide, wherein the enhancer peptide sequence is linked to the carboxy-terminal end of the core polypeptide and comprises a carboxy-terminal WXXWXXXI, WXXWXXX, WXXWXX, WXXWX, WXXW, WXXXWXWX, XXXWXWX, XXWXWX, XWXWX, WXWX, WXXXWXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises NNY-TSLIHSLIEESQNQQEKNEQELLEL (SEQ ID NO:1281), and wherein at least one amino acid residue of the hybrid polypeptide is polyol-conjugated.

46. The hybrid polypeptide of claim 45, further comprising an enhancer peptide sequence linked to the amino-terminal end of the core polypeptide.

47. A hybrid polypeptide comprising an enhancer peptide sequence linked to the amino-terminal end of a core polypeptide, wherein the enhancer peptide sequence comprises an amino-terminal WXXWXXXI, WXXWXXX, WXXWXX, WXXWX, WXXW, WXXXWXWX, XXXWXWX, XXWXWX, XWXWX, WXWX, WXXXWXW, WXXXWX, WXXXW, IXXXWXXW, XXXWXXW, XXWXXW, XWXXW, XWXWXXXW, XWXWXXX, XWXWXX, XWXW, WXWXXXW, or XWXXXW; wherein the core polypeptide comprises YTSLIHSLIEESQNQQEKNEQELLELDK (SEQ ID NO:1278), and wherein at least one amino acid residue of the hybrid polypeptide is polyol-conjugated.

48. The hybrid polypeptide of claim 47, further comprising an enhancer peptide sequence linked to the carboxy-terminal end of the core polypeptide.

49. A hybrid polypeptide comprising a core polypeptide linked to an enhancer peptide sequence, wherein the core polypeptide comprises the following amino acid sequence YTSLIHSLIEESQNQQEKNEQELLELDK; LEENITALLEEAQIQQEKNMYELQKLNS; LEANISQSLEQAQIQQEKNMYELQKLNS; NNYTSLIHSLIEESQNQQEKNEQELLEL; DFLEENITALLEEAQIQQEKNMYELQKL; RYLEANISQSLEQAQIQQEKNMYELQKL; RYLEANITALLEQAQIQQEKNEYELQKL; NNYTSLIHSLIEESQNQQEKNEQELLELDK; TALLEQAQIQQEKNEYELQKLDE; TALLEQAQIQQEKNEYELQKLIE; TALLEQAQIQQEKIEYELQKLDK; TALLEQAQIQQEKIEYELQKLDE; TALLEQAQIQQEKIEYELQKLIE; TALLEQAQIQQEKIEYELQKLE; TALLEQAQIQQEKIEYELQKLAK; TALLEQAQIQQEKIEYELQKLAE; TALLEQAQIQQEKAEYELQKLE; TALLEQAQIQQEKNEYELQKLE; TALLEQAQIQQEKGEYELQKLE; TALLEQAQIQQEKAEYELQKLAK; TALLEQAQIQQEKNEYELQKLAK; TALLEQAQIQQEKGEYELQKLAK; TALLEQAQIQQEKAEYELQKLAE; TALLEQAQIQQEKNEYELQKLAE; TALLEQAQIQQEKGEYELQKLAE; DEFDASISQVNEKINQSLAFIRKSDELL; DEYDASISQVNEKINQALAYIREADEL; DEYDASISQVNEEINQALAYIRKADEL; DEFDESISQVNEKIEESLAFIRKSDELL; DEFDESISQVNEKIEESLAFIRKSDEL; or QHWSYGLRPG (SEQ ID NOS:1278–1285 and 1287–1309, respectively); wherein the enhancer peptide sequence comprises WQEWEQKI (SEQ ID NO:1129) or WASLWEWF (SEQ ID NO:1433); and wherein at least one amino acid residue of the hybrid polypeptide is polyol-conjugated.

50. The hybrid polypeptide of claim 49, wherein the enhancer peptide sequence is linked to the amino-terminal end of the core polypeptide.

51. The hybrid polypeptide of claim 50, further comprising an enhancer peptide sequence linked to the carboxy-terminal end of the core polypeptide.

52. The hybrid polypeptide of claim 49, wherein the enhancer peptide sequence is linked to the carboxy-terminal end of the core polypeptide.

53. A polypeptide comprising the amino acid sequence VYPSDEYDASISQVNEEINQALAYIRKADELLENV (SEQ ID NO:692), wherein at least one amino acid residue of the polypeptide is polyol-conjugated.

54. A hybrid polypeptide comprising an enhancer peptide sequence linked to a core polypeptide, wherein the core polypeptide comprises the amino acid sequence RYLEANISQSLEQAQIQQEKNMYELQKL; RYLEANITALLEQAQIQQEKNEYELQKL; TALLEQAQIQQEKNEYELQKLDE; TALLEQAQIQQEKNEYELQKLIE; TALLEQAQIQQEKIEYELQKLDK; TALLEQAQIQQEKIEYELQKLDE; TALLEQAQIQQEKIEYELQKLIE; TALLEQAQIQQEKIEYELQKLE; TALLEQAQIQQEKIEYELQKLAK; TALLEQAQIQQEKIEYELQKLAE; TALLEQAQIQQEKAEYELQKLE; TALLEQAQIQQEKNEYELQKLE; TALLEQAQIQQEKGEYELQKLE; TALLEQAQIQQEKAEYELQKLAK; TALLEQAQIQQEKNEYELQKLAK; TALLEQAQIQQEKGEYELQKLAK; TALLEQAQIQQEKAEYELQKLAE; TALLEQAQIQQEKNEYELQKLAE; TALLEQAQIQQEKGEYELQKLAE; DEYDADISQVNEKINQALAYIREADEL; DEYDASISQVNEEINQALAYIRKADEL; DEFDESISQVNEKIEESLAFIRKSDELL; or DEFDESISQVNEKIEESLAFIRKSDEL (SEQ ID NOS:1283, 1284, 1287–1303, 1305–1308, respectively); and wherein at least one amino acid residue of the hybrid polypeptide is polyol-conjugated.

55. The hybrid polypeptide of claim 54, wherein the enhancer peptide sequence is linked to the amino-terminal end of the core polypeptide.

56. The hybrid polypeptide of claim 55, further comprising an enhancer peptide sequence linked to the carboxy-terminal end of the core polypeptide.

57. The hybrid polypeptide of claim 54, wherein the enhancer peptide sequence is linked to the carboxy-terminal end of the core polypeptide.

58. The hybrid polypeptide of any of claims 19–21, 23–24, 28–52 and 54–57, wherein the enhancer polypeptide sequence comprises WXXWXXXI, WXXWXXX, WXXWXX, WXXWX, WXXW, XXXWXWX, XXWXWX, XWXWX, WXWX, IXXXWXXW, XXXWXXW, XXWXXW, XWXXW, XWXWXXXW, XWXWXXX, XWXWXX, XWXW, WXWXXXW or XWXXXW, further comprising an amino-terminal acetyl group and a carboxy-terminal amido group.

59. The polypeptide of claims 22, 25, or 53, further comprising an amino-terminal acetyl group and a carboxy-terminal amido group.

60. The hybrid polypeptide of any of claims 19–21, 23–24, 28–52 and 54–57, wherein the core polypeptide is a therapeutic reagent, further wherein the enhancer polypeptide sequence comprises WXXWXXXI, WXXWXXX, WXXWXX, WXXWX, WXXW, XXXWXWX, XXWXWX, XWXWX, WXWX, IXXXWXXW, XXXWXXW, XXWXXW, XWXXW, XWXWXXXW, XWXWXXX, XWXWXX, XWXW, WXWXXXW or XWXXXW.

61. The hybrid polypeptide of any of claims 19–21, 23–24, 28–52 and 54–57, wherein the enhancer polypeptide sequence comprises WXXWXXXI, WXXWXXX, WXXWXX, WXXWX, WXXW, XXXWXWX, XXWXWX, XWXWX, WXWX, IXXXWXXW, XXXWXXW, XXWXXW, XWXXW, XWXWXXXW, XWXWXXX, XWXWXX, XWXW, WXWXXXW or XWXXXW, further wherein the polyol is poly(propylene glycol), polyethylene-polypropylene glycol or poly(ethylene glycol).

62. The hybrid polypeptide of claim 61, wherein the polyol is a straight-chain polyol.

63. The hybrid polypeptide of claim 61, wherein the polyol is a branched-chain polyol.

64. The polypeptide of any of claims 22, 25, and 53, wherein the polyol is poly(propylene glycol), polyethylene-polypropylene glycol or poly(ethylene glycol).

65. The polypeptide of claim 64, wherein the polyol is a straight-chain polyol.

66. The polypeptide of claim 64, wherein the polyol is a branched-chain polyol.

67. The pharmaceutical composition of claim 26 or 27, wherein the polypeptide further comprises an amino-terminal acetyl group and a carboxy-terminal amido group.

68. The pharmaceutical composition of claim 26 or 27, wherein the polyol, used to conjugate the polypeptide, is poly(propylene glycol), polyethylene-polypropylene glycol or poly(ethylene glycol).

69. A hybrid polypeptide comprising an enhancer peptide linked to the carboxy terminus of a core polypeptide, wherein the core polypeptide comprises the sequence NNYTSLIHSLIEESQNQQEKNEQELLELDK (SEQ ID NO:1285); and wherein the enhancer peptide comprises the sequence WXXWXXXI, IXXXWXXW, WXXWXXX, WXXWXX, WXXWX, WXXW, WXXXWXWX, XXXWXWX, XXWXWX, XWXWX, WXWX, XXXWXXW, XXWXXW, XWXXW, XWXWXXXW, XWXWXXX, XWXWXX, XWXW, WXWXXXW, or XWXXXW.

70. A hybrid polypeptide comprising an enhancer peptide linked to a core polypeptide, wherein the core polypeptide comprises the sequence NNYTSLIHSLIEESQNQQEKNEQELLELDK (SEQ ID NO:1285); and wherein the enhancer peptide is 4 to about 30 amino acids in length, and comprises an amino-terminal or carboxy-terminal sequence WXXWXXXI, IXXXWXXW, WXXWXXX, WXXWXX, WXXWX, WXXW, WXXXWXWX, XXXWXWX, XXWXWX, XWXWX, WXWX, WXXXWXW, XXXWXXW, XXWXXW, XWXXW, XWXWXXXW, XWXWXXX, XWXWXX, XWXW, WXWXXXW, or XWXXXW.

71. The hybrid polypeptide of claim 69 or 70, further comprising an amino-terminal acetyl group and a carboxy-terminal amido group.

72. The hybrid polypeptide of claim 69, wherein at least one amino acid residue of the hybrid polypepide is polyol-conjugated.

73. The hybrid polypeptide of claim 72, wherein the polyol is a straight-chain polyol.

74. The hybrid polypeptide of claim 72, wherein the polyol is a branched-chain polyol.

75. The hybrid polypeptide of claim 70, wherein at least one amino acid residue of the hybrid polypeptide is polyol-conjugated.

76. The hybrid polypeptide of claim 75, wherein the polyol is a straight-chain polyol.

77. The hybrid polypeptide of claim 75, wherein the polyol is a branched-chain polyol.

78. The hybrid polypeptide of claim 71, wherein at least one amino acid residue of the hybrid polypeptide is polyol-conjugated.

79. The hybrid polypeptide of claim 78, wherein the polyol is a straight-chain polyol.

80. The hybrid polypeptide of claim 78, wherein the polyol is a branched-chain polyol.

81. A method for enhancing the pharmacokinetic properties of a core polypeptide comprising linking an enhancer peptide to a heteropolymeric core polypeptide, wherein the enhancer peptide consists of an amino-terminal or carboxy-terminal sequence WXXWXX, WXXWX, WXXW, XXWXXW, or XWXXW; and wherein the heteropolymeric core polypeptide comprises at least about 94 amino acid residues, to form a hybrid polypeptide such that, when introduced into a living system, the hybrid polypeptide exhibits enhanced pharmacokinetic properties relative to those exhibited by the heteropolymeric core polypeptide.

82. A hybrid polypeptide comprising an enhancer peptide linked to a heteropolymeric core polypeptide, wherein the enhancer peptide consists of an amino-terminal or carboxy-terminal sequence WXXWXX or XXWXXW; and wherein the heteropolymeric core polypeptide comprises at least about 94 amino acid residues.

* * * * *